United States Patent 7,745,391 (HUMAN THROMBOSPONDIN POLYPEPTIDE) - sequence listing, part 21

SEQ ID NO: 52015 - DNA, 2319 bp, Homo sapiens
ggcccctggccctaaactctgggactggcgggcggtcaggcggcacagggggaatcccgggggcctaaggaggttgtcccagtttttgtcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatgatatgtgacctttttatgtatctggctt

SEQ ID NO: 52016 - DNA, 3248 bp, Homo sapiens
ggcccctggccctaaactctgggactggcgggcggtcaggcggcacagggggaatcccgggggcctaaggaggttgtcccagtttttgtcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttgttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatgatatgtgacctttttatgtatctggcttacttgtggtcccagctactcaggaagctgaggtcagaggatcacctgaacctgggaagcagaggttgcagtgaactgagatcacgccactgtactggctgacaaagtgagacccctgtctaaaaaaaagataaagagagttacctgaatctggaatccttaatcttgggttttccttaaactttctataagtccagcatctgaaatattttgtcaattatcacattaatgtgttcattttgtaagtaagagtactcaatttaaaatgatcttactttaaaagtggcctagtttgcagtgcccagcaggacactgacagtcacagctgtgtgactttttgtgggttacttaatttttttgagcctccttttctcttctattcaatgaggataatagggcctacctcataggattattatgcattcccctctgttaatgcacgtaaagtttttacttggaaaactaactcaccatttaacaaccattctaagcaccatagaatatattttgtttcacaaatttggtattcattcagaataagtatttgaaaagtgagtaaattctatgcaattatagttattaaatgacttataaactgtgtttctcttccacttcttgctacatttaatcttctaggtgttcagatatctttggagattataggcagcaataaagctaaggcagctaacctttcaacattcttgtgtcaggctaatattttggtgaaaggaattcttgtgtttctcaaagaactagagctgaagcagaaataagttccaatgagcaagtgtccaattggaccattgaatgaaatctagtgttttaaacaattctgatgtttcaatgttttgttctgttttcttttgatcttgtgagcagtaagacatattttatgtgggtggtaaaggaagaaatcaagtaacagaatgaggaattgttcccaggaagagttagagttgggacaaatgggttgttaactttgatttttagatcttctctgaagacattaaacatggaatggtcatctttagaaaaataaaagactatgcaactccacca

SEQ ID NO: 52017 - DNA, 2352 bp, Homo sapiens
ggcccctggccctaaactctgggactggcgggcggtcaggcggcacagggggaatcccgggggcctaaggaggttgtcccagtttttgtcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatgatatgtgacctttttatgtatctggcttctttcacttagcataatattttcttttcttttt

SEQ ID NO: 52018 - DNA, 2893 bp, Homo sapiens
atagaaatggggtttcatcatgttggccaggctggtctcaaactgctgacctcatgtgatccacccccccccccccccacgcctcccaaagtgcagggattacaggcgtgagccacggtgcccagcctcctaagacattcttacctggtttctagaaccacctgtaacatttacccactcaactggactttgtttcattttgtttagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatgatatgtgacctttttatgtatctggcttacttgtggtcccagctactcaggaagctgaggtcagaggatcacctgaacctgggaagcagaggttgcagtgaactgagatcacgccactgtactggctgacaaagtgagacccctgtctaaaaaaaagataaagagagttacctgaatctggaatccttaatcttgggttttccttaaactttctataagtccagcatctgaaatattttgtcaattatcacattaatgtgttcattttgtaagtaagagtactcaatttaaaatgatcttactttaaaagtggcctagtttgcagtgcccagcaggacactgacagtcacagctgtgtgactttttgtgggttacttaatttttttgagcctccttttctcttctattcaatgaggataatagggcctacctcataggattattatgcattcccctctgttaatgcacgtaaagtttttacttggaaaactaactcaccatttaacaaccattctaagcaccatagaatatattttgtttcacaaatttggtattcattcagaataagtatttgaaaagtgagtaaattctatgcaattatagttattaaatgacttataaactgtgtttctcttccacttcttgctacatttaatcttctaggtgttcagatatctttggagattataggcagcaataaagctaaggcagctaacctttcaacattcttgtgtcaggctaatattttggtgaaaggaattcttgtgtttctcaaagaactagagctgaagcagaaataagttccaatgagcaagtgtccaattggaccattgaatgaaatctagtgttttaaacaattctgatgtttcaatgttttgttctgttttcttttgatcttgtgagcagtaagacatattttatgtgggtggtaaaggaagaaatcaagtaacagaatgaggaattgttcccaggaagagttagagttgggacaaatgggttgttaactttgatttttagatcttctctgaagacattaaacatggaatggtcatctttagaaaaataaaagactatgcaactccacca

SEQ ID NO: 52019 - DNA, 1834 bp, Homo sapiens
ggcccctggccctaaactctgggactggcgggcggtcaggcggcacagggggaatcccgggggcctaaggaggttgtcccagtttttgtcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttaatatacacgcatagggacacatctgcatatttgagcatacagagacatgtaaatactcaggagagaa

SEQ ID NO: 52020 - DNA, 989 bp, Homo sapiens
agtgcgtgcgtccagcggaagtgctcccccggcgcggtccgccaggccagtgccctcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggacggcccccaagttacatgaactacctgctagactcacaccccagcaaaaatattgatgtccccagcaagattagcttcctgttaaagatccaggacctgtgaatacatgcgtaactgcaagaatggaagcaaaggatgaacccaagttaaagcccagcacaagaatatgatgtaagcgcttttgggaaatgcagagattttcttttctcttcaaataataaattacatctaaaaattaatgagagta

SEQ ID NO: 52021 - DNA, 292 bp, Homo sapiens
agtgcgtgcgtccagcggaagtgctcccccggcgcggtccgccaggccagtgccctcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagtacaaaaatcagctgagcgtggtggcgggcacctacattcccagctactcgggagaccgaggcaggagagtcac

SEQ ID NO: 52022 - DNA, 474 bp, Homo sapiens
tttagagatggggtcttgctacatttccaaggctggtctcaaactcatgggctcaagcaatcctcctgcctcggcctcccaaggtgtaacttctagatgagtgtctgtttatgcatacacaacatatccttccagatcttcatttagttgtgtaattgcttccatgacaggaaccagtaaaccttgataaaaattaaggatccgtcaatcagttattgcaatatctgatttgttggactattttggttagtttttgccttcttgtgtttctaggctattcaggcagctatcagccaggcctttaaaaccccagaggtcatcagattgtttgcaaagaaacaaccaggtcagcttcggacaaggttagcagaggtaaaatttctttaaattgatttggttgctgtgtgtttttcatttcctaggccaattcattatgatatcctatggcttaaaaatttgccaggtgattttaga

SEQ ID NO: 52023 - DNA, 1022 bp, Homo sapiens
ggcccctggccctaaactctgggactggcgggcggtcaggcggcacagggggaatcccgggggcctaaggaggttgtcccagtttttgtcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggacggcccccaagttacatgaactacctgctagactcacaccccagcaaaaatattgatgtccccagcaagattagcttcctgttaaagatccaggacctgtgaatacatgcgtaactgcaagaatggaagcaaaggatgaacccaagttaaagcccagcacaagaatatgatgtaagcgcttttgggaaatgcagagattttcttttctcttcaaataataaattacatctaaaaattaatgagagta

SEQ ID NO: 52024 - DNA, 696 bp, Homo sapiens
agtgcgtgcgtccagcggaagtgctcccccggcgcggtccgccaggccagtgccctcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggacggcccccaagttacatgaactacctgctagactcacaccccagcaaaaatattgatgtccccagcaagattagcttcctgttaaagatccaggacctgtgaatacatgcgtaactgcaagaatggaagcaaaggatgaacccaagttaaagcccagcacaagaatatgatgtaagcgcttttgggaaatgcagagattttcttttctcttcaaataataaattacatctaaaaattaatgagagta

SEQ ID NO: 52025 - DNA, 266 bp, Homo sapiens
ctgccgtcaactatttgagaagctgactctgtccaggtaaccactgcttgacgaatttctttaggaattatccagtggaactggtagcataatcatctctgttgagaaggaatggtctgaaagaagatactctatcttggaaggttttctgttgatatttagagacaagcagcaaatattagctcgaggtcaatgctggagattgtaaaacggctctgcattagtaacactttccaatcacaaggaatgtattttcattggtgtct

SEQ ID NO: 52026 - DNA, 1142 bp, Homo sapiens
ggcgctggagcggcggctgcgcttcggcttcgagcccagctctcctggccccaacgcgggcttagcctcccgccttggctcgggcaggcgcccgtcgacccttcggcccctttcgcccgccctggagctgggggcagggtgccagtggaagcgtggggcttggctctgtgattcattcattctccgccgacgggagcctcagacccgctgtgctctgaagagaggagggaagagggggcagccgcgaatgaagggccgggcaccagccgggctccattgtgctcggcggcggggggcgggaaggggctgagggaggtgggatcgggtcccctcctccagctctccggcgtgcgctgcgcccccagcctgctgccagcctggaaatggctccgtttattctcttcgggagaatgaatcgatcctgcctagccttctcttcgtcctccccacctcttctctgctccgagtcttaggaggagaaacatttaaaaagacagattccaatgtggagtgccgtgcaggttgcgagctgccgggtttgcacttcgaggagattttcctgtgtagtttttttcctaatgtgagcgcagggaagccgtggcattactgcttttgggatttttattcacgtgcacgtcgcgtttggttgctcgctccacccccggagacctggtgtggtggagaaatttgaacccgcagccttagctccgaaaaggccgagttacctggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggatggttcttattctgtggagaagaagggcgggaagaacttcctttcaggaggaagctggaacttactgactgtaagaggttagaggtggaccgagaaggacttttcccagtcttcagtggcacttccca

SEQ ID NO: 52027 - DNA, 5386 bp, Homo sapiens
ggcgctggagcggcggctgcgcttcggcttcgagcccagctctcctggccccaacgcgggcttagcctcccgccttggctcgggcaggcgcccgtcgacccttcggcccctttcgcccgccctggagctgggggcagggtgccagtggaagcgtggggcttggctctgtgattcattcattctccgccgacgggagcctcagacccgctgtgctctgaagagaggagggaagagggggcagccgcgaatgaagggccgggcaccagccgggctccattgtgctcggcggcggggggcgggaaggggctgagggaggtgggatcgggtcccctcctccagctctccggcgtgcgctgcgcccccagcctgctgccagcctggaaatggctccgtttattctcttcgggagaatgaatcgatcctgcctagccttctcttcgtcctccccacctcttctctgctccgagtcttaggaggagaaacatttaaaaagacagattccaatgtggagtgccgtgcaggttgcgagctgccgggtttgcacttcgaggagattttcctgtgtagtttttttcctaatgtgagcgcagggaagccgtggcattactgcttttgggatttttattcacgtgcacgtcgcgtttggttgctcgctccacccccggagacctggtgtggtggagaaatttgaacccgcagccttagctccgaaaaggccgagttacctggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacatagttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagccgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtcattgaactgttgggaagcagttagaggaaaagctcactttttttttcaggtggaaataaaaggaacactcaaaattaagccaacaccaccactacctttaaaaactagtttatttgccctgttaaaattaaatgtattctttaacatg

SEQ ID NO: 52028 - DNA, 3769 bp, Homo sapiens
ctttttgttttattttagttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagccgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtcattgaactgttgggaagcagttagaggaaaagctcactttttttttcaggtggaaataaaaggaacactcaaaattaagccaacaccaccactacctttaaaaactagtttatttgccctgttaaaattaaatgtattctttaacatg

SEQ ID NO: 52029 - DNA, 3693 bp, Homo sapiens
atatcgaggttatctctgccagatcacaagtgtggctggtgtcattctgggtctgactggagccctccatggactgtattctttaattacaaaagccctgcagacatagtacctggtcagaactatgcctcggtttatttatcattttgaaatataatcagaatttctgtgcccatttcattgaaatgggcacagaaattgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagccgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtcattgaactgttgggaagcagttagaggaaaagctcactttttttttcaggtggaaataaaaggaacactcaaaattaagccaacaccaccactacctttaaaaactagtttatttgccctgttaaaattaaatgtattctttaacatg

SEQ ID NO: 52030 - DNA, 3681 bp, Homo sapiens
gagccggcaccctctctctgggtgcttggtgtctgctggtggctggcagtgggcgcagcggaggagagttgtgctgcagctcatacggtgtgtctgtcatctcagtctggagtaaatgcagtgtctgccggtgtctgatgggttctgtccctcgtaatttctgtgcccttgaaatgggcacagaaattgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagccgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtcattgaactgttgggaagcagttagaggaaaagctcactttttttttcaggtggaaataaaaggaacactcaaaattaagccaacaccaccactacctttaaaaactagtttatttgccctgttaaaattaaatgtattctttaacatg

SEQ ID NO: 52031 - DNA, 2448 bp, Homo sapiens
ggcgctggagcggcggctgcgcttcggcttcgagcccagctctcctggccccaacgcgggcttagcctcccgccttggctcgggcaggcgcccgtcgacccttcggcccctttcgcccgccctggagctgggggcagggtgccagtggaagcgtggggcttggctctgtgattcattcattctccgccgacgggagcctcagacccgctgtgctctgaagagaggagggaagagggggcagccgcgaatgaagggccgggcaccagccgggctccattgtgctcggcggcggggggcgggaaggggctgagggaggtgggatcgggtcccctcctccagctctccggcgtgcgctgcgcccccagcctgctgccagcctggaaatggctccgtttattctcttcgggagaatgaatcgatcctgcctagccttctcttcgtcctccccacctcttctctgctccgagtcttaggaggagaaacatttaaaaagacagattccaatgtggagtgccgtgcaggttgcgagctgccgggtttgcacttcgaggagattttcctgtgtagtttttttcctaatgtgagcgcagggaagccgtggcattactgcttttgggatttttattcacgtgcacgtcgcgtttggttgctcgctccacccccggagacctggtgtggtggagaaatttgaacccgcagccttagctccgaaaaggccgagttacctggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacatagttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaatttcaacctaggggatccttattaaaaattacctgtgggccggcagattcattcctaggtaggttttttgttgttgttgtttgtttgtttgtttgttttgagatctcggcttactgcaacctcggttcactgcaacctccgcctcccaggttcacgccattctccttcctcagccttcctagtggctgggattacaggtgcgcaccaccacccccaggtaatttttcattttaataagatggaccgagctca

SEQ ID NO: 52032 - DNA, 2116 bp, Homo sapiens
ggcgctggagcggcggctgcgcttcggcttcgagcccagctctcctggccccaacgcgggcttagcctcccgccttggctcgggcaggcgcccgtcgacccttcggcccctttcgcccgccctggagctgggggcagggtgccagtggaagcgtggggcttggctctgtgattcattcattctccgccgacgggagcctcagacccgctgtgctctgaagagaggagggaagagggggcagccgcgaatgaagggccgggcaccagccgggctccattgtgctcggcggcggggggcgggaaggggctgagggaggtgggatcgggtcccctcctccagctctccggcgtgcgctgcgcccccagcctgctgccagcctggaaatggctccgtttattctcttcgggagaatgaatcgatcctgcctagccttctcttcgtcctccccacctcttctctgctccgagtcttaggaggagaaacatttaaaaagacagattccaatgtggagtgccgtgcaggttgcgagctgccgggtttgcacttcgaggagattttcctgtgtagtttttttcctaatgtgagcgcagggaagccgtggcattactgcttttgggatttttattcacgtgcacgtcgcgtttggttgctcgctccacccccggagacctggtgtggtggagaaatttgaacccgcagccttagctccgaaaaggccgagttacctggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacatagttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtaatttcagggctgatgtctatagggatttagggctaacaggttttcttgatcagaagaaatttgcatgtagattcagcacagggatatcttctagttctaggatgtcagaacatagatatgggttgtatgatatgcatttgtttgattaagaaaaatattttccatagtttaatgagaatgaagaatatacgccttttgaagtcaacaaaccatgttgattccccatattatccatggggactagcagtaatgcacaagtacataaaagcactaatgtattagtgctagttgattagtactgacatggtagttaaagtgtgt

SEQ ID NO: 52033 - DNA, 433 bp, Homo sapiens
atatcgaggttatctctgccagatcacaagtgtggctggtgtcattctgggtctgactggagccctccatggactgtattctttaattacaaaagccctgcagacatagtacctggtcagaactatgcctcggtttatttatcattttgaaatataatcagaatttctgtgcccatttcattgaaatgggcacagaaattgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatcgacgtgaaacctcagcaattcctagtcacaatgttgtaagatcgatcgatcgatgaatagctgtga

SEQ ID NO: 52034 - DNA, 273 bp, Homo sapiens
caaaatacttcatagtgcacagacaactgtttggaattaggtttcatttcctgtcattttcatattagaagctataattggtttggaggctatattgcttgtgtagagtcagttattcagaaaatgaataactttactaaggtaaaagtgggcactgtgacctatttttatttggttaatgtatgtagtctctatacattcagtttgcagaaaagtttcaggaatttaaagaagctgctcgactagcaaaggaaaaatcacaagagaagatgg

SEQ ID NO: 52035 - DNA, 599 bp, Homo sapiens
tgcttaggtgactctagagatccccttaaatgggcacagaaattgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaatttcaacctaggggatccttattaaaaattacctgtgggccggcagattcattcctaggtaggttttttgttgttgttgtttgtttgtttgtttgttttgagatctcggcttactgcaacctcggttcactgcaacctccgcctcccaggttcacgccattctccttcctcagccttcctagtggctgggattacaggtgcgcaccaccacccccaggtaatttttcattttaataagatggaccgagctca

SEQ ID NO: 52036 - DNA, 4915 bp, Homo sapiens
ggcgctggagcggcggctgcgcttcggcttcgagcccagctctcctggccccaacgcgggcttagcctcccgccttggctcgggcaggcgcccgtcgacccttcggcccctttcgcccgccctggagctgggggcagggtgccagtggaagcgtggggcttggctctgtgattcattcattctccgccgacgggagcctcagacccgctgtgctctgaagagaggagggaagagggggcagccgcgaatgaagggccgggcaccagccgggctccattgtgctcggcggcggggggcgggaaggggctgagggaggtgggatcgggtcccctcctccagctctccggcgtgcgctgcgcccccagcctgctgccagcctggaaatggctccgtttattctcttcgggagaatgaatcgatcctgcctagccttctcttcgtcctccccacctcttctctgctccgagtcttaggaggagaaacatttaaaaagacagattccaatgtggagtgccgtgcaggttgcgagctgccgggtttgcacttcgaggagattttcctgtgtagtttttttcctaatgtgagcgcagggaagccgtggcattactgcttttgggatttttattcacgtgcacgtcgcgtttggttgctcgctccacccccggagacctggtgtggtggagaaatttgaacccgcagccttagctccgaaaaggccgagttacctggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacatagttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagccgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttggccctatgcgtcttctttattaaccatgaatcatcattaaagctgtttttaatttcaaatacaa

SEQ ID NO: 52037 - DNA, 3537 bp, Homo sapiens
tgcttaggtgactctagagatccccttaaatgggcacagaaattgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagccgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtcattgaactgttgggaagcagttagaggaaaagctcactttttttttcaggtggaaataaaaggaacactcaaaattaagccaacaccaccactacctttaaaaactagtttatttgccctgttaaaattaaatgtattctttaacatg

SEQ ID NO: 52038 - DNA, 3500 bp, Homo sapiens
acgggatccaggtcaccaaacggttttctggggatactgagtcacgactacagtaaatcatggtcctagacggtttcctggtgtgcaaaaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagccgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtcattgaactgttgggaagcagttagaggaaaagctcactttttttttcaggtggaaataaaaggaacactcaaaattaagccaacaccaccactacctttaaaaactagtttatttgccctgttaaaattaaatgtattctttaacatg

SEQ ID NO: 52039 - DNA, 1579 bp, Homo sapiens
ggcgctggagcggcggctgcgcttcggcttcgagcccagctctcctggccccaacgcgggcttagcctcccgccttggctcgggcaggcgcccgtcgacccttcggcccctttcgcccgccctggagctgggggcagggtgccagtggaagcgtggggcttggctctgtgattcattcattctccgccgacgggagcctcagacccgctgtgctctgaagagaggagggaagagggggcagccgcgaatgaagggccgggcaccagccgggctccattgtgctcggcggcggggggcgggaaggggctgagggaggtgggatcgggtcccctcctccagctctccggcgtgcgctgcgcccccagcctgctgccagcctggaaatggctccgtttattctcttcgggagaatgaatcgatcctgcctagccttctcttcgtcctccccacctcttctctgctccgagtcttaggaggagaaacatttaaaaagacagattccaatgtggagtgccgtgcaggttgcgagctgccgggtttgcacttcgaggagattttcctgtgtagtttttttcctaatgtgagcgcagggaagccgtggcattactgcttttgggatttttattcacgtgcacgtcgcgtttggttgctcgctccacccccggagacctggtgtggtggagaaatttgaacccgcagccttagctccgaaaaggccgagttacctggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatggggtaaggatttttgtgcttaacacagcttcgaatctgtttatgtatgtgtattattgagcggtggtggtgattgtgttttgtgttttcaaacaaacttgccaccttgctaagctggtcatactttaaagaaataggcatgctaaccttttaggttatttttgcatttttgtagagcggtaccagaggtcataatttaaaaacacatatatcgtttgtaacttgaatatggatttgtgagtaatgtttacaaagacaacgcattctacactttactggtcagactgctgcatcagtttgtaatcaaaatcacattattttagcttttgctgacggttatctttcaaagagaagtactgcattctctcagtacttttagataatcagttgcacaaaggaacgattttaatgagtggttagacaacagtccttgaaagtgatccagagtaaattgttgccctcaccgtgc

SEQ ID NO: 52040 - DNA, 1705 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgatggagttttgctctgttgcccaggctggagtgcaatggtgccatctcagctcactgcaacctctgccgcttgggttgaagcgattatcctgtctaagcctcccgagtaactgagccagccatgtttgttaataaaaatggggacaatactgtatatatatggttatattttagctttttcacttttcagtatctcctgaggcttttctcatgtcattaaatatttttctaattt

SEQ ID NO: 52041 - DNA, 4545 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtcttttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52042 - DNA, 3185 bp, Homo sapiens
atcgctaggtacgaggctgcgctgagggatgtcttgtatatttctctggcttgatattccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52043 - DNA, 4545 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaatgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52044 - DNA, 4492 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52045 - DNA, 4569 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaggttcccggttgggtacgaagaacgatatatagtctctccaaagatgcaatgcggatctatcaacagtgttgattgccaaggagagaagtccatccctaagctggcccacgtttacaccgggttcatgacaacacgtcgggatataccaacaatcgtcgcgaacacaatttaacccggcttctctctatcactactactatatttgtgactcacgacacgacacgcagaagacaccacgacgcccacgacacgcatgt

SEQ ID NO: 52046 - DNA, 981 bp, Homo sapiens
gagccggcacctattttatgttgacccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52047 - DNA, 948 bp, Homo sapiens
gagaatactaactctaacttagtattctactccaagacaaagggtattaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52048 - DNA, 2543 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagtgggagaggaagtcgaaccactgctgtgtgtccttgtcaggatgctcacttgttcctactgagatgctggatattgattttgtaacagcacctggtgtttcacggctgtccgagtgagctaactggcggcgttggatgcat

SEQ ID NO: 52049 - DNA, 277 bp, Homo sapiens
cagggccgccccaggcagcaggagtgtccccaccctcagtaatagaggccctcgtctgttcttgttcctccacagtgtggggctttggttttctcagtgtctcactgattaacctggcctctctcctgggagtcctcgtcctgccctgcacagagaaagcgtttttcagccgtgtgctcacttacttcatcgccctgtccattggaacgctgctgtctaacgcgctattccagctcatcccagaggtgcagtagaacagaaacttgcgcgtcctctt

SEQ ID NO: 52050 - DNA, 4599 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52051 - DNA, 4599 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggctttggttttctcagtgtctcactgattaacctggcctctctcctgggagtcctcgtcctgccctgcacagagaaagcgtttttcagccgtgtgctcacttacttcatcgccctgtccattggaacgctgctgtctaacgcgctattccagctcatcccagaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52052 - DNA, 4548 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52053 - DNA, 4545 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcatgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgtt

SEQ ID NO: 52054 - DNA, 4662 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttaagaaaaaaacgggtgatcatttgcaataaatgtggatgtaatgaaggctgttgaacacaagg

SEQ ID NO: 52055 - DNA, 4278 bp, Homo sapiens
gcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtcgtctcgcggttgtagcctctagaaaca

SEQ ID NO: 52056 - DNA, 302 bp, Homo sapiens
tggtggagcctctaagaggttgactcaggcttaccttgagggcacatggtccagcctttgacgctgtgggccctgggggtgtgctttctcctaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctag

SEQ ID NO: 52057 - DNA, 1260 bp, Homo sapiens
gtgctccatcgtgggtggggtaaagcggggtgggagccgatggtccgtttcctgaaggcacaggccagcttagcctgggtgctcagaggacctcggctggggtacacgtttgggggctgggagaccgttgctgaaggcagcgatcatgtggcggcggcactaggcggagtcagacggtcacgtgattgggaggggatcacgtgacggagggcggctgaggagcgcggggtggctgcctttaagtcacgtgacatgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgttggggtccacgagtttgttgccccctcgggttgggtcccctttggccgtttgtggtgtttttcttttcctttttggccccgtgtttttttgtgttccccgggtttttttttttttttttattcttttcctcctggttttgggtcacagccacatcactcacagctgatcactggttggtggaaattaaactttgagcagcagattacgttaaaaaa

SEQ ID NO: 52058 - DNA, 703 bp, Homo sapiens
gataatgcctcccccctcgaatgccggggcgcggcacacagcagtgcgacggggaagaaagcccacaagcagggccatcagcaccgcaacatgcccgcagcccacaccagtgggcagagccaccaaccagccaagagcagctcgggcccatcaaacgtctggcccagatgcagcacgcaagcttcacatgcctggcatcccacgagtcttgtgagttagtaccacatgggcaagctggccggcgctcctgggtgtgatgggtgtcctgcccttaagtgctgctcttacatgcctggcaaccaaccaggctccacagaattggcacggattcacacagctgtctcctcctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactc

SEQ ID NO: 52059 - DNA, 205 bp, Homo sapiens
tctgacccacttgccgtcgcttccaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaccgttacatgcaaggggtcccgagctcgaaattc

SEQ ID NO: 52060 - DNA, 2658 bp, Homo sapiens
agataggaccggcgggggctttgctagagtggattgggcgacatggaggggcacacgtctactttgggccacactgggattttctggcctatggtggagcagattgtactatgctgagggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctacctagtcaacctgtctctcaatgacaacgatggctccagtggggcttcagaccaggataccctggctcctctgcctggggccaccccctggcccctgctgcccactttctcctaccagtaccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactc

SEQ ID NO: 52061 - DNA, 2807 bp, Homo sapiens
gtgctccatcgtgggtggggtaaagcggggtgggagccgatggtccgtttcctgaaggcacaggccagcttagcctgggtgctcagaggacctcggctggggtacacgtttgggggctgggagaccgttgctgaaggcagcgatcatgtggcggcggcactaggcggagtcagacggtcacgtgattgggaggggatcacgtgacggagggcggctgaggagcgcggggtggctgcctttaagtcacgtgacatgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctacctagtcaacctgtctctcaatgacaacgatggctccagtggggcttcagaccaggataccctggctcctctgcctggggccaccccctggcccctgctgcccactttctcctaccagtaccctgccccacacccctacagcccgcagcctccaccctaccatgacttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactc

SEQ ID NO: 52062 - DNA, 221 bp, Homo sapiens
gcagaggcgagagcaggagttggaagaagaacctgaggcctttttccactgtgggtgctcccaggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggaga

SEQ ID NO: 52063 - DNA, 401 bp, Homo sapiens
gtgcgggattgcttttgaaactggactaagaggtttgagtcagactcaaggaagtctttggagcagcactgtgcccctgagggtgcgttagggagaggagaaataaggaaaggggattgagtttggagatttcttaggtgtcggagtgagttctttcaatgtaagagaagacctgaacagggcaggagaaagtcaacatcctggagccaggtgaagattgggagaaagtttgatgggggtcggggtggggatggttggtccagctcactgacctctaccttgtcgcttggcagggtggtgaaggaagaaatttcagatgacaacgcccgcctcccctgcttcaacggaagggtggtatcctgggtaagaggttctgacaccgaggaccaggccccctcagc

SEQ ID NO: 52064 - DNA, 3257 bp, Homo sapiens
gtgctccatcgtgggtggggtaaagcggggtgggagccgatggtccgtttcctgaaggcacaggccagcttagcctgggtgctcagaggacctcggctggggtacacgtttgggggctgggagaccgttgctgaaggcagcgatcatgtggcggcggcactaggcggagtcagacggtcacgtgattgggaggggatcacgtgacggagggcggctgaggagcgcggggtggctgcctttaagtcacgtgacatgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctacctagtcaacctgtctctcaatgacaacgatggctccagtggggcttcagaccaggataccctggctcctctgcctggggccaccccctggcccctgctgcccactttctcctaccagtaccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactc

SEQ ID NO: 52065 - DNA, 3291 bp, Homo sapiens
gtgctccatcgtgggtggggtaaagcggggtgggagccgatggtccgtttcctgaaggcacaggccagcttagcctgggtgctcagaggacctcggctggggtacacgtttgggggctgggagaccgttgctgaaggcagcgatcatgtggcggcggcactaggcggagtcagacggtcacgtgattgggaggggatcacgtgacggagggcggctgaggagcgcggggtggctgcctttaagtcacgtgacatgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctacctagtcaacctgtctctcaatgacaacgatggctccagtggggcttcagaccaggataccctggctcctctgcctggggccaccccctggcccctgctgcccactttctcctaccagtaccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactcaaaaaaacgcaaaaccaatcaaacaaaaaagggg

SEQ ID NO: 52066 - DNA, 2000 bp, Homo sapiens
gtgctccatcgtgggtggggtaaagcggggtgggagccgatggtccgtttcctgaaggcacaggccagcttagcctgggtgctcagaggacctcggctggggtacacgtttgggggctgggagaccgttgctgaaggcagcgatcatgtggcggcggcactaggcggagtcagacggtcacgtgattgggaggggatcacgtgacggagggcggctgaggagcgcggggtggctgcctttaagtcacgtgacatgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcgggtgcagcgggggcgccgggggccacgtagtggctggggaagacgccc

SEQ ID NO: 52067 - DNA, 308 bp, Homo sapiens
ggaaaagggttaagagataataaatacaaaaacataggtgcctcagaacactgtttttaaaaaaactttgtattcattttaaaaaatgacttttggtgtacaattctgtgagttttaacaaatgtacagatttgtgaaaccaccacaacaatcaggatacagaacaatttcatcactggtcaaaagacttctttatgctgctcttttgtagtcaaatcctgcccagcccttaccccctctagcaaccactgatgtattctctgtttttacagttttttgtgggtttttgttgctgttgttcttatttt

SEQ ID NO: 52068 - DNA, 286 bp, Homo sapiens
ggagtgagactctgtctcaaacaaagaaacaaacagcaacaacaacgaaagcatatggaataaacatgctgcaaccatccctgcaaaggatcctgccaggcaggcggttctgcttccttttgtaatagtttgcctggcagcagcttttgtaacactccagtgaggtaaagatggagtaacatcaatttgaggcttagatttataatttctaattgtacatactagccataaacagaatgttttactttacaacgtattatgagaggaacactcttaaaaaaaaaaa

SEQ ID NO: 52069 - DNA, 859 bp, Homo sapiens
cagtctggacttaagtgcagtactttctaattaaccacggcacagtgacaggcaacttcaccctactgcaacccaagacctgactggcacgaggaaaggtgcaataatgaagagttttcttctagtgtcaatgccctggcattaaccctgccttttttggctgtggaggttcaaaaccagaaacaaccagcatgccatgagaatgatgaaagaccattctatcagaaaacagctccatatgtcccaatgtattatgtgccaaatagctatccttattatggaaccaatttgtaccaacgtagaccagctatagcaattaataatccatatgtgcctcgcacatattatgcaaacccagctgtagttaggccacatgcccaaattcctcagcggcaatacctgccaaatagccacccacccactgtggtacgtcgcccaaacctgcatccatcatttattgccatccccccaaagaaaattcaggataaaataatcatccctaccatcaataccattgctactgttgaacctacaccagctcctgccactgaaccaacggtggacagtgtagtcactccagaagctttttcagagtccatcatcacgagcacccctgagacaaccacagttgcagttactccacctacggcataaaaacaccaaggaaatatcaaagaacacaacgcaggacttgctgaaaccaaattactacttcacactctccttcagccatttgtctgccttcagtcaacagaaaatgtgattttcacagattcagctcttctctccttacattttacattcatgccacattcaatattttgattcttgcacaataaagccaactgattgcaactga

SEQ ID NO: 52070 - DNA, 296 bp, Homo sapiens
gtgaccctgagccaggagtgagtaactctgaacctcatccgtaaacagatcattctacggtcgagtgtccctcatctgaaatgcttcagaacagagtgtttcgttttttgggtttttgtttttttgagacggagtctcgctctacctcccaggctggagtatagtggccagatcttggctcactgcaaccttcacctcctgggctcaagccatcctcctacctcagcctcctaagtagctgagactacaggcacacgccaccacgtccagctaatttttgtacttttagtagagat

SEQ ID NO: 52071 - DNA, 936 bp, Homo sapiens
tttggcaagcctggtttatatccatctacaaggtttgcgaacccatgttgccgatttttttttctgctacagaacaactcccttggtacaataaaaaagacgagtatttacttttcattgaaagtggagaacctgaaaaggaacctggaaagaagcagctggaaaaggtgagaggaaaacctagagtgtgtgttatcctgcaagccaattgagaatggagcttgcttgatatttcactagataaagaatttaaggcgagtatctatctttgttctccttggcaactgagagtctgcccttggaaacatcaggcaccatggggaagcgggataatcgggtagcctatatgaatcctatagcaatggccagatggagaggcccaactcaatctgtgggcccaacaatccaagattatctaaatcgaccaagacccacctgggaagaagtaaagaaacaattagaaaataaaaaaacaggttcaaaagcattagctgaatttgaagaaaaaatgaatgaaaattggaagaaagaacttgaaaaaagcagagagaaattattaagtggaaatgagagctcatctaaaaaaagagaaagaaagaaaaagagaaagaagaaatcttgtcggtcttcatcttcttcatcaagctctgattcttcaagcagttcttcagattctgaggatgaggaaaagaaacaaggaaaaaggagaaagaaaaagaagaaccgttcatacaaatcatcccaaagctctacgcatgaatcagaatcagagagcaaggagtctgtaaaaaagaaaaagaagtcaaaggatgaaacagagaaagaaaaggatgtaagaagcctcagcaaaaaaagaaagaaaagttaccctgatgataaacctttatcatctgagtcctcatctgaatcagattatgaagaggatgtgcaagcaaa

SEQ ID NO: 52072 - DNA, 230 bp, Homo sapiens
attttaccaagacacatacatagtgaaaatcaaatagtctgaaaagacttacagtgagaaaaagtaaaccttgaccacttctcaattttcaattctgcttccaagaagtaaccatttttcaattctctgcaatttttatcaggtaaacttctttcttcatgcaccctgccaccctacatcagatccaacacagtagccagagtgatttttaaaatgtaagtcagacctgg

SEQ ID NO: 52073 - DNA, 391 bp, Homo sapiens
ttcccagcactttgggaggctgaggtgggaggatcacctgaggtcagaagttcgagaccagcctggccaacatggtgaaacctcatctctactaaaaatacaaaaattagtcaggggtggtggtgcacacctgtagtcccagctactcaggaggctgaggcaggagaatcgcttgaacccaggagatggaggttgcagtgagctgagatcacgccactgcactccagcctgggcaacagagtgagactccgtctcaaagagaaaaaccaaaactctcgtgtttgctttctaggacactactcagggccaccgtgactcagcttacccaaattacaatcctttgtttcccaaataaatgcttaatactattaaaagtgaacaatgaaaaagc

SEQ ID NO: 52074 - DNA, 595 bp, Homo sapiens
tgagacggagtctcactctgttgccaggctggagtgtagtggcgcattctgctcactgcaacctccgcctcctgggttcaagcgattcttctgcctcagcttcccaagtagctgggattacaggcacacgccatcatgcccagctaaattttttgtattttgtttttagtagagatggggtttcacggtgttggtcaggctggtcttgaactcctgacctcatgatccgcccacctcggcctcccaaagtgctgggattacaggcgtgagccaccgcccccggcctgtgtctggtgtcattttaactgaagttcttgagggatagtttcaaagcctggttttcaaaacctgacaagtctgtgatttcccaatttccttatttgttgttgttgttgtttttcagacagggtcttaccctgtcatttaggctggagtgcagtagggcgatcgtagttttttactgcagcttcaaaatcctagacgcatgtgatcctagctactcaggaggctgaagcaggagcccatgagttcaaggttacagtgagctatgatcgtgccactacacttcagcttgggcaacagagataccttgtca

SEQ ID NO: 52075 - DNA, 735 bp, Homo sapiens
gaggtcttcacttcaacatacgagttgaccatggcatgctctgggctccagtcctctacaaagacgtagggcaggaactaccagttgtcagcacagcaccatcccacattgctcttctaatggagcctttcaccccagatgttctttctcgtctgatgggaaggatccaagtatgtaaagattatgttatagatcagctttggtctgtcctaaaagaaatttgccagtggattattccatatggataaaagtcagtttctctggtcttcctggaatgtgtctagaaaggcaaatagattatttacaagttcatagtaggatccaatgtattgggattaaaatatggacaaacataatttgggtccattgtgagcatgccagcttggtcaactattcaccacacatgatgccctaaatataactctaggttttcttatgcccaagagagggacatactcttgggtgtctggactagggaaacatgtatgaaaaaccatttggccactctacatcttgttattggagaattgaaaccatctatattcaaagatattattaaaaggcaagaagttaaaaaataaaaaaataaattgcatgtctgttgttatggaattttataactgtacataccttttatttaatccattcacaggtcatattataggatatctttcatttaataagtatactaaatccataccttatactgttgagttttgatagtaccagagggaa

SEQ ID NO: 52076 - DNA, 1666 bp, Homo sapiens
accgtgaccctgccgtgatgggcggggcggcaggggaggaaccagactgcgagcggagaagcggagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccgtcaacctcatacgtatctacctggtctctgatcgaagctaccgtaatgtgttcttgaggtcaacatgttttgtggaagtcactgtatttgcccctttatgtcaattacctattataaaccgagagaaatgggaaaattaaaaacctgttttgaattatttttaatgcagaactattttttcaagtgaaatcttatacagaagtctggtatatgaaacagataaaaatgaaccaatgagattgaagggaatgagtagcatgtaatcctgcccactcttcggagaatttgaggcaactttgtagagccttaggagttcagtttgtatgttactgggtaatttaaagcagaaattttaatctgactgcacttaagaatcatctgaagtgtttgtattggttagtcttatttttaatactgatgtcctggtctctctcccctcaaaaaaactctgctgctgggaccaagcacatagatgctttttaaaaagctcccgaaaatgactctaatatgcagccaggattgaaaataactaccctacacagcatttttcctgattctgagcactcagcttttcattgattttccctagggcaagtccttcatcttattctgggtccttgtgttttctttctgaacctacaatttctccataggtcccatggttttcaaaatttctcattttccattttctgtccttttatattacctacttgaaaaccacagtcatctttcaaaacaaaacactgcctgtttcttaggtctttattgtgggcttgttattcctcaatacaaatttacataaaataataacaattaagacatgggccttggtgtcagaattattttatatctttcttattaactctgcagcttaccagctctggataagttaaaggacagctatagtcttactacatagaatcattataaggaattggtggagtgatccttataaagtgtttgcatggtacctagcacagagaaagtgcttgaagttgttaactgttatggttacaaaatatgtaaataatttttattgtccaattttctctcttcatatacactaaattgttctaattcttgaaccac

SEQ ID NO: 52077 - DNA, 2186 bp, Homo sapiens
accgtgaccctgccgtgatgggcggggcggcaggggaggaaccagactgcgagcggagaagcggagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaaagaaattaagaggagaaaaagagagatctagagggccggtccaggagatacaatctatgcataataggaatacctgaaactgaggacagagcaagtggagctgaaacaataaaggatctacttgaaaaaattttccagaattgaagaacgaactagatctacaaatggaaaaggctcataggatacctttaaagtttaatgaaaagaaagcagcatctagacatatccgggtgacgtttttgaatttcaaagacgaaacattttacaagcatccagtcagagaaagcaggttacttacaaaggggcaaaagtcaggctgacctcagatttttctcctgcaattctaaatgccagaagacagtggaacaatatctagagtgttaagggaaaataattttgagccaagaattatatactctgccaagttatcatttctttacaaaggaaactggaagacattcttagatatacaggggttaggaaagtatatcaaccaagaactttccctgaaaattttgctgaaggatttactgcagctaacagagaacctgaattaaaataagaatagggaggcaattgtatgaaagaactgatggtatgcattaaaactagttaaggagcattaagtttaaattgttatgtatagggcattaaaactaaatacaaaaatagaaacataagctgggtgtaaaatttcagtttacgtttaaactggaagggcataccacatgttcaatatattggacaaatactgttttatttttagcatgtagtattgtagatacaaatacgcatgttcttaagctaaacctaagtaaaagggctttgtcactgtagatttgacaaataacattctaaatgtcaaatctgacaattggaaaacagtacagttttatttcccttatttttaagtatagcaggaaaaaaataacaagtttgtccatgttactactgatactgtaaagaaacttccaaatcactggtttgggagggggtggatacatcctcattttctgtacatgatgcatggggaaaaacagtagttactgcatcatatagttccaagtaaatcatatagttccaagtaaatttgacatggaaataagtgttaactacaaaaatagaatatatacattccaatgtttggaaaagaagtggtaaaaagaaaaatagcaaaaagacattaaaattagcaaaaagtagattgacagtacagatgacctataaactggttaaatagccctattacaattgaaattgggtcaaaaatcaatctctaacctgagatacatttgtataaaacaaatgatcaaagagtttaaagataatggaaactataaatcatagaaatggcaacatttttcttaaaatctaaacataagacattttatgtaaaacatacaatataggatgtaacatttaacaaactatatggtaaataatatgacattaatatataaaatatatgttccagatcttgatgtgggtgatagttttacttatgtacatcgatatacatctatttaaaaacatgtacatttaaattgttgcattttatgtatttaaaatttattgagtaatccttctgtatgtattattaaagagaatatagcaaaaaaaaaatgttggact

SEQ ID NO: 52078 - DNA, 2160 bp, Homo sapiens
accgtgaccctgccgtgatgggcggggcggcaggggaggaaccagactgcgagcggagaagcggagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaaagaaattaagaggagaaaaagagagatctagagggccggtccaggagatacaatctatgcataataggaatacctgaaactgaggacagagcaagtggagctgaaacaataaaggatctacttgaaaaaattttccagaattgaagaacgaactagatctacaaatggaaaaggctcataggatacctttaaagtttaatgaaaagaaagcagcatctagacatatccgggtgacgtttttgaatttcaaagacgaaacattttacaagcatccagtcagagaaagcaggttacttacaaaggggcaaaagtcaggctgacctcagatttttctcctgcaattctaaatgccagaagacagtggaacaatatctagagtgttaagggaaaataattttgagccaagaattatatactctgccaagttatcatttctttacaaaggaaactggaagacattcttagatatacaggggttaggaaagtatatcaaccaagaactttccctgaaaattttgctgaaggatttactgcagctaacagagaacctgaattaaaataagaatagggaggcaattgtatgaaagaactgatggtatgcattaaaactagttaaggagcattaagtttaaattgttatgtatagggcattaaaactaaatacaaaaatagaaacataagctgggtgtaaaatttcagtttacgtttaaactggaagggcataccacatgttcaatatattggacaaatactgttttatttttagcatgtagtattgtagatacaaatacgcatgttcttaagctaaacctaagtaaaagggctttgtcactgtagatttgacaaataacattctaaatgtcaaatctgacaattggaaaacagtacagttttatttcccttatttttaagtatagcaggaaaaaaataacaagtttgtccatgttactactgatactgtaaagaaacttccaaatcactggtttgggagggggtggatacatcctcattttctgtacatgatgcatggggaaaaacagtagttactgcatcatatagttccaagtaaatcatatagttccaagtaaatttgacatggaaataagtgttaactacaaaaatagaatatatacattccaatgtttggaaaagaagtggtaaaaagaaaaatagcaaaaagacattaaaattagcaaaaagtagattgacagtacagatgacctataaactggttaaatagccctattacaattgaaattgggtcaaaaatcaatctctaacctgagatacatttgtataaaacaaatgatcaaagagtttaaagataatggaaactataaatcatagaaatggcaacatttttcttaaaatctaaacataagacattttatgtaaaacatacaatataggatgtaacatttaacaaactatatggtaaataatatgacattaatatataaaatatatgttccagatcttgatgtgggtgatagttttacttatgtacatcgatatacatctatttaaaaacatgtacatttaaattgttgcattttatgtatttaaaatttattgagtaatcgtgagggggaatcctcgagagtcg

SEQ ID NO: 52079 - DNA, 1882 bp, Homo sapiens
gaaaaattataaccaagcataatatagcaaggactaacccctataccttctgcataatgaattaactagaaataactttgcaaggagagccaaagctaagacccccctcgtgccgaattcggcacgagagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaaagagagatctagagggccggtccaggagatacaatctatgcataataggaatacctgaaactgaggacagagcaagtggagctgaaacaataaaggatctacttgaaaaaattttccagaattgaagaacgaactagatctacaaatggaaaaggctcataggatacctttaaagtttaatgaaaagaaagcagcatctagacatatccgggtgacgtttttgaatttcaaagacgaaacattttacaagcatccagtcagagaaagcaggttacttacaaaggggcaaaagtcaggctgacctcagatttttctcctgcaattctaaatgccagaagacagtggaacaatatctagagtgttaagggaaaataattttgagccaagaattatatactctgccaagttatcatttctttacaaaggaaactggaagacattcttagatatacaggggttaggaaagtatatcaaccaagaactttccctgaaaattttgctgaaggatttactgcagctaacagagaacctgaattaaaataagaatagggaggcaattgtatgaaagaactgatggtatgcattaaaactagttaaggagcattaagtttaaattgttatgtatagggcattaaaactaaatacaaaaatagaaacataagctgggtgtaaaatttcagtttacgtttaaactggaagggcataccacatgttcaatatattggacaaatactgttttatttttagcatgtagtattgtagatacaaatacgcatgttcttaagctaaacctaagtaaaagggctttgtcactgtagatttgacaaataacattctaaatgtcaaatctgacaattggaaaacagtacagttttatttcccttatttttaagtatagcaggaaaaaaataacaagtttgtccatgttactactgatactgtaaagaaacttccaaatcactggtttgggagggggtggatacatcctcattttctgtacatgatgcatggggaaaaacagtagttactgcatcatatagttccaagtaaatcatatagttccaagtaaatttgacatggaaataagtgttaactacaaaaatagaatatatacattccaatgtttggaaaagaagtggtaaaaagaaaaatagcaaaaagacattaaaattagcaaaaagtagattgacagtacagatgacctataaactggttaaatagccctattacaattgaaattgggtcaaaaatcaatctctaacctgagatacatttgtataaaacaaatgatcaaagagtttaaagataatggaaactataaatcatagaaatggcaacatttttcttaaaatctaaacataagacattttatgtaaaacatacaatataggatgtaacatttaacaaactatatggtaaataatatgacattaatatataaaatatatgttccagatcttgatgtgggtgatagttttacttatgtacatcgatatacatctatttaaaaacatgtacatttaaattgttgcattttatgtatttaaaatttattgagtaatccttctgtatgtattattaaagagaatatagcaaaaaaaaaatgttggact

SEQ ID NO: 52080 - DNA, 1621 bp, Homo sapiens
gaaaaattataaccaagcataatatagcaaggactaacccctataccttctgcataatgaattaactagaaataactttgcaaggagagccaaagctaagacccccctcgtgccgaattcggcacgagagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccgtcaacctcatacgtatctacctggtctctgatcgaagctaccgtaatgtgttcttgaggtcaacatgttttgtggaagtcactgtatttgcccctttatgtcaattacctattataaaccgagagaaatgggaaaattaaaaacctgttttgaattatttttaatgcagaactattttttcaagtgaaatcttatacagaagtctggtatatgaaacagataaaaatgaaccaatgagattgaagggaatgagtagcatgtaatcctgcccactcttcggagaatttgaggcaactttgtagagccttaggagttcagtttgtatgttactgggtaatttaaagcagaaattttaatctgactgcacttaagaatcatctgaagtgtttgtattggttagtcttatttttaatactgatgtcctggtctctctcccctcaaaaaaactctgctgctgggaccaagcacatagatgctttttaaaaagctcccgaaaatgactctaatatgcagccaggattgaaaataactaccctacacagcatttttcctgattctgagcactcagcttttcattgattttccctagggcaagtccttcatcttattctgggtccttgtgttttctttctgaacctacaatttctccataggtcccatggttttcaaaatttctcattttccattttctgtccttttatattacctacttgaaaaccacagtcatctttcaaaacaaaacactgcctgtttcttaggtctttattgtgggcttgttattcctcaatacaaatttacataaaataataacaattaagacatgggccttggtgtcagaattattttatatctttcttattaactctgcagcttaccagctctggataagttaaaggacagctatagtcttactacatagaatcattataaggaattggtggagtgatccttataaagtgtttgcatggtacctagcacagagaaagtgcttgaagttgttaactgttatggttacaaaatatgtaaataatttttattgtccaattttctctcttcatatacactaaattgttctaattcttgaaccac

SEQ ID NO: 52081 - DNA, 1347 bp, Homo sapiens
accgtgaccctgccgtgatgggcggggcggcaggggaggaaccagactgcgagcggagaagcggagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccgtcaacctcatacgtatctacctggtctctgatcgaagctaccgtaatgtgttcttgaggtcaacatgttttgtggaagtcactgtatttgcccctttatgtcaattacctattataaaccgagagaaatgggaaaattaaaaacctgttttgaattaaaacaaaacaaaaaaaaacaaaaaaacaagaaaaaaaaaaaaaaaaaaagaagaaacaaagaaaaaaaaaaaacaaaaaaaagaacacacacaagaaaacaaacaaaaaaacaaaagaacaaaaaaacaaagagagaagaagaggggagggagcgacatgcgagaaaacacttaccgagagcctgacacagcgcgaaatgaaagaccggcagaccacaccgaaacaacagaagacgagcgacaaccccaagacacaactcagagagccaccgaagatataactaataggaacaaccagaggagaatgcgccaatagacataataaaatacaacaagagacacaagtgagaaggggaagcgacgagaagagacaagacggcgagcggcggagggactggaggtgggatgaagggaggaagacaaagaacaagtggagtaggggcgtggtgggagtagatacatacaggcaccagagagcggagacaaaacaacaatacacacgagacgagcgagaaaatgaaagagtggaagtgggagaggaagagaaaggaaagaaatcacgggagcgaagagagcaggggaagagggcgataggagatagactgaacgaggt

SEQ ID NO: 52082 - DNA, 918 bp, Homo sapiens
aaattttaaaaataagaacaaatggtgactggagggaaaaacaagaggaaagaaaacgagcagtaatcaaaatcttgggagaattattttcagtttgattttgtgaattttatttatacaataaataataatgctaactgagggtcaaattaatctatgagaatgttataaatgaccttaaatcagcacatttggagaagtaaaaaactgaatctgtgactgaactctgtcttcatttatcataaaaaccgtacacaatttttaatcttccaatgtctcagtgacacctatttccagattagtggtcctcgaactttagtacatgtcagaatgtcccagaatgcttgtgaaaaatacggatttctgggttccatcctcaaatactcaagttcagtagatgttggttgggacccagaaagatgcaaggacttcaggacatcttttaaaaacattaatatggagaataatgagccaggagggaaataactctttgagtcagagaatgccactgattttaggaattctgaccgtatcaaatacaaattttagaatttaaatatttgttcatggtgatatattagaaatctaacataacacatattggtgaaaaaataattataaaattgtctgcagttaggtaacttggttgtttataatcaaactgtttagacaataacattgaaatagttactgaattgaacacttccttattttatagacgaataatatggagctcaggtagtcaaagtaatttgcacaatatcatgtcactagctagggaccaggcaagatatttgctctttccattcattatgttgtgttcctttcaaaagtctctataagtctccaatattatcagaaggacttggggtaagccaagaaccccattagacgataccttcggctcatgtaggaaaa

SEQ ID NO: 52083 - DNA, 907 bp, Homo sapiens
agagtaaactgaacgatctactcatagcagaattcctggtataattgagtccatcctcctttattcttctgcaggtgtcttggctactccttttctctccaggctgtgggcaaactctctgctcctgagttggtctagaatcttgttcctggggccactgcttgccagggcgttacaccaaattaaattattggaaacatacatgtgctgagactcttccacatccaaggtgctgtctaggggctgctcagggtgcacagataagtaggtgccaatatcctgcctctggcggctccagtaggagaacaaagcaagtgtggggaaggtgtggggttggaagagttacagagggccttgattttcaaagggagaaattatacttggctgagtagttgccagtgtggagcaaatgggggtttcagatgggagagtgaatgtacattcagaattctgctttaggtagagcagcaggtgagcagggcatgaggtttagcaggatgcaggataacccatcaaaagcattgaagtgagaagctgaccaccagcaaagcagtgggtttgaacggtaaagacagatgggagccacataagagacagcatctattgagacccccccaacccaaccgacctaagtgaaagcaaaagagaagcaatgaaagctcaagatgaggctgaggtttggagcccctgggactgaggctatggagaagcctttaatagaataagaaacaatagatcaagtgtctcagggtgtcattagggatgagcttagcttccacaataccactacaaactccccacatacactgaccctgcctcttaattttccagcctgcccgcctagccaaaagcatagggaaggccctcggggtgcatttctgtaggcaggggtcattcctgagcagat

SEQ ID NO: 52084 - DNA, 590 bp, Homo sapiens
agtacaagcaacagcacatttccttcccccttctccttactgcctcccataaatatgcacacccttggccagggcctgtgcagacacaagggtcagggtacttagtgatcatccagacagaatttcagaccttctgttggaggcatttaggcaattctggaagcctttctggcagaagtgtatgtagagcaagattgggaggtaaggagggataggactggatgtgaaggctcttgaggcatggggaggaacctcagagccagggaggatgagatgggacaaaaggatatgcttatctgaaggagtacaaggtgagatggtaaattctagattatggaagggataataggacacgtacagtgcctcacgcctgtaatcccagcactttgggaggccgaggcgggcggattgagcccaggagttcaagacccagcctgggcaacatagtgagactcttgtctctaaaaagttaaaaaaaaaaaaaaaagaatctttgataagtagttggatccttggaagagttgagaacagatgagatgtggttggaattgatggtgcctactcctcatcagggccctaggcccctaatg

SEQ ID NO: 52085 - DNA, 922 bp, Homo sapiens
agcctctctgggaagatgctgcttcttcctctccccctgctgctctttctcttgtgctccagagctgaagctggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcctgagccagcctgaaagggaagctggaactggacctgagcagcaaagtgtgtgccactcattctggtctacccttggtccctcagccacaaccctaagcctccagaagtatcctacaggtcacagaactctcaataaacctcagtgaagacaca

SEQ ID NO: 52086 - DNA, 384 bp, Homo sapiens
tggctaatttttgtatttatgtagagatgggattttgtcatgttgcccaggctggacttgaactactgggctcaagcaatcctcctgctttgccctcccaaagtgctgggattacaggcgtgagccaccgcgcccggcccccccaattactcttaaaggtaacatcactattgtgaacctaagatcagctttttgagatgccttttcaggtgtaatggttaatactgagtgtcagcttgattggattgaaggctacaaagtattgatcctgggtgtgtctgtgagggtgttgcaaaagagattacctggggaaggcagatgcacagttaatctggtgggcacaatctaatcagataccagcgaatataaagcaggcagaaaaac

SEQ ID NO: 52087 - DNA, 353 bp, Homo sapiens
aggggtaatgggggcattggtgagctgcccagcatgcaccaggctccactcccgctgcccggccagatcaaggagtccacggagggaggccagcgagtccagcagcaggaaaacccctgacctcagccatgagggatttatctttggggttaataagaaggtaatttagaaagtggattttgcaggaactggaagctgaggattatgatttcagattgcagcactgacggtcctatcctgttgcctcttaacctgcccacactcaagcccaggttatggggagacagcctgacttagctcagaaggccgctgggaggggaggctggaggctcccagggctatcagacatcggg

SEQ ID NO: 52088 - DNA, 303 bp, Homo sapiens
atgtatacatgtgccatgttggtgtgctgcacccattaactcatcatttaacattaggtatatctcctaatgctatccctcccccctccccccaccccacaacaggccaatttctaatattccataatctctctctgtctctctctttggtcttcgtatgctacttcttcttcctctgaattttgttgagctaaatgtagtgatgcatgtatttctgccatggcgagtattgatttgcgcagccagagccttccttttgcatgatcagcaaaatatgccagccctaggtgtgaataacccggc

SEQ ID NO: 52089 - DNA, 517 bp, Homo sapiens
ccaaataaaataaaaccagaaaagagcagtgccggcctgtgtcccctgaattcctacaattgtcagattgacatggatgttccactgggggccgtgagctggaatcccgggggcaaaaagcctcactcttttagttttctgttctattccgatgatgctgacacttgctggttcatttggccttcctgatagcaaagaaagggcttgagactccaggagataattttccatgaaaaggagaagccttgtcatccacaactcagcgtaaggcagagttcaaagtgaagacttcccagagcagcccaggcactgttggtcctctttgcctgtctcatttttctccatagtgcttgttactgcgtgccttcatatgcatgtatgtgtctgcttatttttgtcttcactaaattgtaggcaccttaaggggagagggctttgctttcctgattgctctgtgtcaggatcctgcttaacctatagcacgtgctcataaacccagttgacagactgtgtggaa

SEQ ID NO: 52090 - DNA, 360 bp, Homo sapiens
tcctcccttcatttattcattcattcctttggtaaatacttgtgtcgttatgtgccaggcactgttctgattgctggagcttacgttctattaataaagacacactagtaaaatctgtagtgtattagaagcgattaagagaaaaatcatgcagggatgaagggaaggaagcatctctcagttctttggggaagtctccaaacgatgtcccccctctgttcttggtcatgaccttctcctaccctaacccggcagtggtggtttctgaggccagccatgaggtttcagggaaaccaggcccatgtccagctagaacccagccattccttcctgcccatgttgctgctgcagttgtgccga

SEQ ID NO: 52091 - DNA, 831 bp, Homo sapiens
cgagattctgactcaaaaaaaaaaaaaaaatgctaatttaaattaatcttggcttcatcctggaccattccctgaggggcagcacagggcagctaagcttaaggtatttctcctatataggttttttgttttgttttgtttttgatacaagatctggctctatcgcccaggttggagtgcagtggcatgatctcagctcactgtaacctgtgcctcccgggctcaacggattctcccacctcagcctcccaagtagctgggactacaggtgcacaccaccatacctggggtagttttttgcatttttagtagaaatggtgttgtgccatgttgcccaggctggtcttgaacccctgggcctcaagcgatttcgcccgcctggggcttcccaaagtagttgggattacaggtgtctgagccactgtaatccaaaaactgcacctggcaggttttgtttttgatgtttaaaaatctaataagtaccttttcttttaataggtgagtgtctcatttacattctaatagatatgtttaaccctagtcctttcttttttctgctttacatgcttcttaattttcttacaattgctatgtgagaggtgttctttttgttttcttctttatggtattttggaaactatgtagtttatttagagttattccagtgattacttgtataactttaaataataggctgaaaattattggctttgaaaactaaaagtttgtataacttccataggaaaggtgaggagaccaggatacctcttattcccatgtgtctgagtctttcctttcctaggttccttaagtgttgtatctgaaaaaaaa

SEQ ID NO: 52092 - DNA, 581 bp, Homo sapiens
ttgttttaaattaatgattctcagtcttgactgtacattgcaatctcttcaagagttaaaaaaaatatatcgactcctggatctcacccttaaaaatgctgatttaggccgggtgcagtggctcacgcctggggcttcccaaagtagttgggattacaggtgtctgagccactgtaatccaaaaactgcacctggcaggttttgtttttgatgtttaaaaatctaataagtaccttttcttttaataggtgagtgtctcatttacattctaatagatatgtttaaccctagtcctttcttttttctgctttacatgcttcttaattttcttacaattgctatgtgagaggtgttctttttgttttcttctttatggtattttggaaactatgtagtttatttagagttattccagtgattacttgtataactttaaataataggctgaaaattattggctttgaaaactaaaagtttgtataacttccataggaaaggtgaggagaccaggatacctcttattcccatgtgtctgagtctttcctttcctaggttccttaagtgttgtatctgaaaaaaaa

SEQ ID NO: 52093 - DNA, 242 bp, Homo sapiens
ttataaggaagaaagggagaatggatattaagggatatttaacaatctcaaagacttatcgtgtcaaggtttggtatacatggtaggtagacaatcaccagaatgttagtttttcttctcctcgcccttttatgagtttggaaaaatggacatttcattcagactgcatcatttagaaatacctatgacaaaacacaacgacatgttggcacaggcgtaattgccatgaactgcatttttgg

SEQ ID NO: 52094 - DNA, 449 bp, Homo sapiens
cttttagtaactggtccttgtctgcacttgttactctgagctgcccgctgccagcctacatcagtcgcatgcactgggagtcttggtgaggcagcatgttcctgagctcaagttgcaggcactgccatccccactgcatggggccctgtctcagagagaaaagaatgtgaagccccacttcctgtggaatctttgagccccctgctaacttcttgccatcacagtaacctcagctacttatgcttcttgtctctccttgctccacaggcctccctctgccttcacaggggcattttcacctcgcattagtcattgcgggaagacaggaagcaccatacctatcaagcagctcctgctttctggcctggaagaaactattaagaatcaggccatgttcttgaaatggagaaaagcatttcagggagaacaaatgtaaattaatatttaat

SEQ ID NO: 52095 - DNA, 842 bp, Homo sapiens
agcccaaagtgaaaacacagtggaggttgggcacggtggctcaagcctgcaatcccagcactttggaagctaccatacccagccccaaactctaactttatagtacagtggggaaaagtctgcttatcttaattatggataaatgggcacttagtctctacaatgttggcatacatgctctccctcaaactgatggcataatgattttatatatatgtgtgtgtgtgtgtgtgtgtgtatatatataccattaaaaggtgggctaatgtggctttccactacagctcttaccagatttttttattttcagtgtgatttggctggaatattaataacagttggttgacatgtattcacaattgcatgacttctctttggaggctggtaggttgagtattgttctttttatccatcctttcccctcccctaaatgtcagtctttctgcttttaggattatatttgaattttcaggggtttatacaccaccactggagagtagaaggccactaacttgcaggcagttaacttatatctttacaagctacattctattttaagagcctatttagggtaacatttaaagatttgcttatcactgtattctcatccactgaaatcagtccagctttaccttggagaaaaagcagatgggaaacaggcaaggggaaaagcaaaaaagaggaaaaaaaagactggggtcacagtttcgatgaatgttattccctgtatttggtgagtggtgggcactagcagctcaatttcactgctagctaatagtggcaaattaagattaaactataaactatttgacattactccattatgtattttgagtctcatg

SEQ ID NO: 52096 - DNA, 830 bp, Homo sapiens
gaaaaatatttttgttggaatttaagtttaatggctaaatatgaagactccttgatataaaatattgtgtttaaaatgtcatgcatgttatactgaaatattctggagatgtctgaagcagttctttaagcagcactgtgtattatggaaaaatgtttgtcttttacctagcatatttgtaaatagacctttaataagaagtgtgtgtgtgtgtgtgtgtgtgtgtatatatataccattaaaaggtgggctaatgtggctttccactacagctcttaccagatttttttattttcagtgtgatttggctggaatattaataacagttggttgacatgtattcacaattgcatgacttctctttggaggctggtaggttgagtattgttctttttatccatcctttcccctcccctaaatgtcagtctttctgcttttaggattatatttgaattttcaggggtttatacaccaccactggagagtagaaggccactaacttgcaggcagttaacttatatctttacaagctacattctattttaagagcctatttagggtaacatttaaagatttgcttatcactgtattctcatccactgaaatcagtccagctttaccttggagaaaaagcagatgggaaacaggcaaggggaaaagcaaaaaagaggaaaaaaaagactggggtcacagtttcgatgaatgttattccctgtatttggtgagtggtgggcactagcagctcaatttcactgctagctaatagtggcaaattaagattaaactataaactatttgacattactccattatgtattttgagtctcatg

SEQ ID NO: 52097 - DNA, 304 bp, Homo sapiens
aagaatatcagactcaaaggtcaagtgtttaagattagggagaaagcagccttaaaagtacattttaaagagcctcacaggtcaacaagtcagccttagagcctgccatgcaaccaccacttccaggctgctaggggaatcagaaatgtcactatctttcaaacttagaatattgattatatccactctactcataggggctttattccatgacatctcttagttagcaatttaagaaaatgatttcatcctatataatgccagattagctcaatgacaaaaaatgttacactaggagctcttc

SEQ ID NO: 52098 - DNA, 732 bp, Homo sapiens
tagccggctccattgggtggacgaccgatttgcacgtcaggaccctattttgcttcttctccaaaacactgtctatatcttgttaatgcttgttttgaattatctccatattgttggaggcaattcacagagaacacagttaagatggcagtcagatacataaatgaaatgccaccctttccttctgctttggactgccctgagaattcttgaacttcctcctgtcctaccttcccttatcaacaatcatgtggtcccatgatcagtggcatgaacattttaaagtttttcaaaatttactattttcctacgagacactgaactccctgaaaataggaagtctcaattaaaaaatcaatttgtcatggtccacataaagataatcaatacattttgctctcagtccttgggatggtttttgtaaataatattagcttgacaaaaacaaacaggaagatcccacccccaacacataccacattccaatgttacctggaattaaaatatataccaacatgcatctttaggttactctggtccatggtttcctccagtggcaatggaatttacaaaaatgtaagacgtaatagatatataattatcttttttcctaaatgaaactagccttaaaaactggtacataatgttcctggttcaatgatcaaaattatgaagtacacttaacctatcttccattgagtggctttaaatggaaccttaaactgtgactca

SEQ ID NO: 52099 - DNA, 331 bp, Homo sapiens
cccccagaaccctgtctgcttcatggtccctttcacaacttcaaagcctctttcctccctgtctccccaagaaagggccaatctgaactaattaggtaatcagactcagctgaaaatttaaaagcaaaaatgcctatctgggcacacacaaaaaaatctgatacatgtatgtgctgcaaatgcagactcatcaagtttcagcaagaaactttccgtgttttttttatcccacaaaagccttctttgtctgctattttcttaaaagtcacaaagagagccttagagatctgcagcttaccctttaaatggaatgggaaagtatttccagaca

SEQ ID NO: 52100 - DNA, 142 bp, Homo sapiens
gtatatgcaggaattagaatgagactatcaggaaaatctatcacataaagagagcagattttagataaattataaactcattgttgaaaattatgagttatccatgaaaagcttttacaattttttagatagatctgctaaa

SEQ ID NO: 52101 - DNA, 308 bp, Homo sapiens
aagtaaattgagtagcaacataaatagggggctccattagtgataacaggtgaaaatagatgggttcagattctgggactgaaaccccagaaacaaagatggtaaagaacatacaggttagattcagtaacctcagttgtaacagataaaccctgaagactctataacttaagacaagactattttaattattgctcatatcccaatttaacaagggttggtgaggaagaggctctgcttcataaactccttcaggaactcagtccttccaaatagtggaaatcctgtcctcctctgggccctggagt

SEQ ID NO: 52102 - DNA, 288 bp, Homo sapiens
  misc_feature (163)..(163): n is a, c, g, or t
  misc_feature (186)..(186): n is a, c, g, or t
  misc_feature (247)..(247): n is a, c, g, or t
  misc_feature (275)..(275): n is a, c, g, or t
gatgatttagtttccaggctagcctacagaagcttatttaacttattatgtctctgagatatactaaggggtagaaaggaagtatagctagctttcccctctctttccaagttacatggttagtcccaagcataattttgagagcacgggagagccggctctngaaccccagggctgtagtctctntggccctgccgtgcgctgacaccaaggcccaaggttcggcccggtagagattcaacacggnttttcttgccccgcgatgaatgtttttngcagaaagagctt

SEQ ID NO: 52103 - DNA, 908 bp, Homo sapiens
ctccagcatccaaggagagtgtgggcagctggagccaggtcctcctcctcctccttctcctcttcttcctccttcgtttcttcctttcctcctccacctgcctattgcagagcagcagaaagcaaaggagctagaaaagggtgaaatcaattctttttctgtaacctttttgctttgcttttattaagttcttaaggcttttggtcttgagtcctagataagatgcaaataattctgaagggatcataacttttaatattatcagtggatatttaagaaaaaaataaaaccataagatagactgatagatagtagagaataaaaagaagattcaggagaggccatggggaggcaaaggaagagaaaggagtggagagtgtgcatgagtgtgtgtgagtgtgtgtgtgtatgagtgcatgtgagagagagagggtgggggagggagggagagagagagtgagagagggagaaagagtggaaattctagaaagaaattgcctcttcttctgttcaactacttcactgttttgtcaaaagttagcactgcctctaaggtctcctgcaactcacccacccacccctcttactccatggtattcaacttctaaactaagaggaaagcccgagctagaggtcctatgcatcaatcagggaagagatattgagaagaataaacagagaaactgtattttttctctcaactaaaacatccattttaatcaatatttggcaagaaaatatatacctgtttcatcttcactggttatttccataaactggaaagaaggactgtctaaatggtagttatgtcccatgagatgtttaagcaaaagggaaaattatacaaaaaagaatgccatattttgtctgcgccaccagaatgacaataaaaatttatcatgctagaa

SEQ ID NO: 52104 - DNA, 822 bp, Homo sapiens
ctccagcatccaaggagagtgtgggcagctggagccaggtcctcctcctcctccttctcctcttcttcctccttcgtttcttcctttcctcctccacctgcctattgcagagcagcagaaagcaaaggagctagaaaagggtgaaatcaattctttttctgtaacctttttgctttgcttttattaagttcttaaggcttttggtcttgagtcctagataagatgcaaataattctgaagggatcataacttttaatattatcagtggatatttaagaaaaaaataaaaccataagatagactgatagatagtagagaataaaaagaagattcaggagaggccatggggaggcaaaggaagagaaaggagtggagagtgtgcatgagtgtgtgtgagtgtgtgtgtgtatgagtgcatgtgagagagagagggtgggggagggagggagagagagagtgagagagggagaaagagtggaaattctagaaagaaattgcctcttcttctgttcaactacttcactgttttgtcaaaagttagcactgcctctaaggtctcctgcaactcacccacccacccctcttactccatggtattcaacttctaaactaagaggaaagcccgagctagaggtcctatgcatcaatcagggaagagatattgagaagaataaacagagaaactcggtgctatctgaaagtggacaacttcagcattacagcccctttctgggacatccctgaaagacggtggagaagaaaaatgccccccacccctgtgggcagaacttctggcagtgcatctggttgtgtacttcgctt

SEQ ID NO: 52105 - DNA, 649 bp, Homo sapiens
  misc_feature (9)..(9): n is a, c, g, or t
  misc_feature (129)..(129): n is a, c, g, or t
  misc_feature (172)..(172): n is a, c, g, or t
  misc_feature (336)..(336): n is a, c, g, or t
  misc_feature (400)..(400): n is a, c, g, or t
  misc_feature (423)..(423): n is a, c, g, or t
  misc_feature (449)..(449): n is a, c, g, or t
ccctcaatntctaaccaaacagtattatcacatttgtagtttacaaaaagtaatttttgtgcatttcatttttaaaagtctgagatggtgtaatctcactaagaaaagagatactattctttctaaganaattgttggacagcataaagtattcctttgcaagcctaggaanaaaagtatagggaagttataactctgagaaagctgcaataaatcaatggacaaaaggaggaatgatatgtagagatttagtgatgtgccacatttcctactaaacacaacattaaatccagctattcacgctacactcattaactttatatccagagtctcatntcacataaagttaaactggcatcatgatgttaaaacaaaaacacttagggaacggcactgatgngagactattgaaaagatcatggnagagaactattttgaaattaaaatgnttcccttattttccagatctgcacagttttttgatacaaaatatttatcttcctttgtcacattttctccaggaaacagaaatgcctcacttatcctataactcatcttgcaactgctgcaaaagaaaaattcacgtttgaatgttctccttaaaaagcaaataaaatttaatacatttttcttaagagtagtccaaaaa

SEQ ID NO: 52106 - DNA, 542 bp, Homo sapiens
taagtttatggagtaaatagtagatctcaaataactaataagagatagtgaaggcttatgtttctatgttgtttagatttaaaggccatgaggttgtctctgggcctcagcctgggattcctgatgacacgacactgaggaagacatttaaatattaattcttaccaaagctgtcttgtttcagccctattttttgaacttccatttgtttatgctgatggatgacatgcaatagtaatagatgttttgagaaatacaggctgcagtgtgctcttgtttgggaaaaatctgttaactcagccaaatgcttaaactagcactgtttaccttcttggttttataatacaaaaaattatctagaaagcatcctgatttgccttttagttaatttgaataattaagaatgaactagcggccgggcgcggtggctcacgcctgtaatcccagcactctgggaggccgaagcgggcggatcacgaggttgggagatcaagatcatcctggctaacatggtgaaaccccgtctctaccaaaaattacca

SEQ ID NO: 52107 - DNA, 376 bp, Homo sapiens
tttatgaaaaaccccctgtatgaaaaacactgggggaatctctcagacacacggaaggaaaagcaaacgattccatttccatccgagtttccgtagtggaagacagcctttcccacagtgctcgcctgccaagcatcttcctgtaggaacttgtcagtgccgccattagttgtttgcaaagggattacgctttggcagccatgctaatcgctccaaggtgaccctttatttggagaaacaaatccttttcagttgttgttacggtacactaatccaaccatgcaagtagctgtttgggaaaaaaattatcaaagtgcattttctgcccactacttctttctctccagatcgctcctaactaaaagtgctgtttctt

SEQ ID NO: 52108 - DNA, 390 bp, Homo sapiens
agtacatgctgggccccaatctagatctcaagggaacggccttcagatccatttttgacaagttccttttgtgagtcctatgatcatgcaagtttgagaactgagaagggaggggaagacctacctccttgttactcagaccaccagcaacagcagcatcacctgggaacctgttacacatgcagaatctcaagccccaccccagacattgaatgagaatctgcattttaacaagttctccatgagatttgtgtaaacttaaagtgagagaagctcacatggactatgtctttttcctttacgtgaatatcgagtacaaagaattgagccagtcagtcctcttggttaatggcacattatgattaatgcatgcatgaactctgattcgaa

SEQ ID NO: 52109 - DNA, 321 bp, Homo sapiens
gggaccacaggcatgcaacaccatgctcagctaatttttgtatttttttgtagagacgaggtttcaccatgttgcccaggctggtctcaaacacctaggctcaagctatctgccagcctcagcctcccaaaatcctgggattacaggtgtgagccactgcccctggccaatatttatgtgtttgtcatttatttaaattagtaatattgatgttattgattttgtaatctgggtattattataaaaatatattctcttacaattgatattttgtttccctcagaaaagtcctaataaactgtttgaagacatcaaaataga

SEQ ID NO: 52110 - DNA, 490 bp, Homo sapiens
  misc_feature (441)..(441): n is a, c, g, or t
  misc_feature (477)..(477): n is a, c, g, or t
acttatctgcagacttgtaggcagcaactcaccctcactcagaggtcttctggttctggaaacaactctagctcagccttctccaccatgagcctcagacttgataccaccccttcctgtaacagtgcgagaccacttcatgccttgcaggtgctgctgcttctgtcattgctgctgactgctctggcttcctccaccaaaggacaaactaagagaaacttggcgaaaggcaaagaggaaagtctagacagtgacttgtatgctgaactccgctgcatgtgtataaagacaacctctgggaattcatcccaaaaacatccaaagtttgggaagtgatcggaaaggaacccattgcaaccaagtcgaagtgatagcacactgaaggatggaggaaatctgctggaccagtgtccaaatcagaaattgacagaaaatggcagngtgaatcgcgataattgtcggttcgcaacttcttantccagaaggagat

SEQ ID NO: 52111 - DNA, 401 bp, Homo sapiens
gcacgagcacaaatagcagttgtgttctttacaaaaattgtatctcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52112 - DNA, 4828 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52113 - DNA, 4792 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacattttcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52114 - DNA, 4893 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaaaaaataataatatataaaaaaaaactcgaggggggcccggacccaatctgcctttgtgagtcgat

SEQ ID NO: 52115 - DNA, 4980 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaaaaaaaaaaaaaaaaaactatagaaaggtgtccccactgtacacatactacttggtcaaggacccaaacccgtctggcccagcaacaattctgagcctttaagtcattctctgagcatataaactagaagttaccagagcctcctcctttagc

SEQ ID NO: 52116 - DNA, 4613 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52117 - DNA, 4775 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaacctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52118 - DNA, 4073 bp, Homo sapiens
acccgactaccgctaagaaaccctctcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52119 - DNA, 5391 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgaaaaaaaaaaaaaaaaaaaaaaaaaaaaatttggtgtggcggcggcacaccgcaccctcgaaaaaggcgtctcgaaacacactgcatgcgaggcaccgcgcccacaaaggataacgacacctgggtccagacggataccacaagaacacagcggacaaccaacagggtcccggttacccaccaaaaaaaaacgcgcgggacaccagacgtcctgaacacaccacggaggacgtcagggcgcaccaagggggcctaccaaaggggtccaggggagcggaataatccacccgccgggggatcaacagaaacaagaacaagacgaagacagcagacaacaacaccacaacgaacgaaacacgaccaaacacgatgaagcgagaacacacagaaaagagcaacacacaagacaagacgagcaggagagagaggacgaaagagaggaaggggagagaacacgacatgaaagaggaagcggaaggacaaagagggaggacagagaacgcggagaagcaaaaagagaacgaaagaaaacagaggaaaacgacacagagaggagacagagcggagagaaacaagcacgaagaaccaatcagaagaaggaaacaacaacgaggccgacagaacgacaagcaagagaacagagggagacgaaccaagacgaaacaagggaacaaagacagagagaaggaacaaaaagaacgacaacaagaagacacaaaaagaacagaagaagcacaagaaagagaagggagagagaggagagaagaatcaaaaagaaagaaagaacagagaagaacaaacgaagaaaagggaaaggacaaagcagaggacaagcagaccgagagaagaacagcagaaagcagagaacggagcggagacagacacgtgagcgaggataggcggagcagcagaagagctcagcgagacgtcaagaaaacgcagacataaagaaagaacgaagacatagagaaagaaggagcacacagaagacggaaggcgagagaacgagacagaggagagagacgacggcgggagcgaaagccagaagaacgagagagacacgaacagacaaggagaaagaactaaaggccgcagaggagaacagaaggaggaaaagaagaggagagaagagcaggcgagaagtcagagagagcacgacagagcatgcagcacg

SEQ ID NO: 52120 - DNA, 4186 bp, Homo sapiens
tggtaaagctcttactttttaaactacatttgactccagtgaaataacttatttatttattcctccaaattgaaccataactgttgaatgcactcgtaggaaatcagaattgtgacccctgtcctcagggtcacaaagccattagcctcctactatatgctgtatgagtgaaatcatctatatgtgcagctacaaagcggacaagtctgtgtgtgtgtgagtgtgcctataggaaatgattgcgtttggcactagtcctttactgtacagctgaacacctagaaagatttattataacttcattaaaaatatcatccattatattcaatatccacttatactattggttttaacacagattacctagtagtattttctacatggtatttttagatgacctttagtaaaatataaaggcataatgtcgttttataaattattttccaattttgaacacaactcgatttttaaagatactttacctgtttttttttttaaatgatgtaatatattagacttgaaaagtaaaagtattggagatctgtgactgaaaaaaaaaaactttatagtgattttattgtatcaagagactttctgtttcagaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52121 - DNA, 2508 bp, Homo sapiens
catgatctgaggatttaaattcacaaaacctgcaatttgacgctgaatttacatgctgtagtaaagggagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52122 - DNA, 1591 bp, Homo sapiens
tgagcactgagcctccttgaatttcagcctgaaaaatgtatgctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52123 - DNA, 899 bp, Homo sapiens
agtcccatcaggatggctataataaaaaacaaaaaaacagaaaacaagtattggtgaggatgtggagaaactggagaccttgtgcattgctgatgggagcaagactggaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52124 - DNA, 425 bp, Homo sapiens
gtcagactggtcagtggaatgcagcaccctggctctgctggaggcgtctatgagacaacacagcacttcattgacatcaaagagcacctgcacatagtaaagagggacatagataacttagtgcagcgaaatatggtaactttgtttccttttccttttataattataatctttaggaaaggaagaactcatactctactgcaagtattttaaccctttagttaatgctaatgcttatttttaatgtttaaggtagaattgtcccatttattgcagatctccatgtgtcctggttttctagttattgaaggtggaagaacagttcccatagcagtcatggttttttaatatgtaatatttatattatcatttcgtgaaaatattttctgatttccatgttaatgtcttctctgacccatggattg

SEQ ID NO: 52125 - DNA, 592 bp, Homo sapiens
ccagaactaccaccatttccatcatgtttgtctacggtccacttcattatatttgttgtggtgcaaactgtattattcattggttatatcatgtataggtaagtctcttgataaaatgtgacccaatatttttctgcatctgtttaattagaaatattcaactaagttatctatgttcataatacaattttcaccacctataaaattaagtttattgtgatttctgttcatttcagttcacataaagtgcacgtgtagaatatatgtttatcttaatgcgttgtatacttcaaaaggcattgatattttaattttaaatagtcctgtttctttccaaagttaagcgtatagaacttctttaagtgtttgtttctttttttcattaggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccaca

SEQ ID NO: 52126 - DNA, 5049 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaatttgctttttccttcattgatcttggataataagttgccatttgtttttcagacacaacctgtattgtgatagcatttcatttatcacatgctttaggctctgcccgaggtggcctgctgcatgcagaggcagtacatggaagcatgccacgagaacatagaaatggtcatggataactgtttacccttgctggtaatgaaaaatacaaactaattaaaac

SEQ ID NO: 52127 - DNA, 4647 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52128 - DNA, 4782 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52129 - DNA, 4566 bp, Homo sapiens
tcttgcttacctgcatgtagcaaagcccagacatcaagcatggtgggtgcagactgtccgtgtgacccaacaccgtgaggctgtgagccctggcagcactccaaaacaatagccttgcaaaacgtactccccagaaagggttccacaattgatgagattggtcactactctgcatattagcacattaaagatttctttatgaaggatcctttataaagaaaggataaataaacctttattagacctcacatttcccagactgacttaactatggaattttttttcacctaatgtctatgagtgatcatggagctagtgttttcaggtacacgttttgaagagactggctggacacgtgactgctacttattggttttcacctctctgtacatctcagtctggtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52130 - DNA, 4577 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacattttcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 52131 - DNA, 887 bp, Homo sapiens
ctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcggattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtgggaaaatatgattatccctgcacaagggcattttggaatatctgctgcaactggaggtcttgcagatgaccatgatgtcctttcttttctgactttctcgttggcctccgaaagcagcagtctgggttgtttgtccgtccaaaaagtccttgttcttacttata

SEQ ID NO: 52132 - DNA, 245 bp, Homo sapiens
agggggatggcttgagcctgggaggttgaggctgcagtaaaccgagattacgccactgtactctagcctaggtaacaaagtgagaccatgtctccaagaaaaaaataaaagaaaacaaaaaaacttgaatccgtaatttaaagatcttcccatgaagaaaataccaggtctagatggttttgcagaagttcaagtaagggtaactctttaaaaaaaattattattattattttttttagaaatgg

SEQ ID NO: 52133 - DNA, 1707 bp, Homo sapiens
cggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaa

SEQ ID NO: 52134 - DNA, 2065 bp, Homo sapiens
ttctttattggcggtcgcggaatggagagtaaacggagaagggtttcccgggaggtcgaaggggagacgtcggtttccgttcccccgccccccgagtcggcgcttggccggcggcctctcggagttctcagagcgtcgctttcttccctttggaggtcgtgagcagctcgtcgggacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaa

SEQ ID NO: 52135 - DNA, 1694 bp, Homo sapiens
tgggctcaagtagacctaagtcatcccaccatcatagccaacctaattaaattttaatactttcagtctggacaccagatatccatgaaggtgttgttataagttcaagtcagctctacttgatatgaatagaggccatttgtagatagtgatgcagtgtttgccaaataaggttagcaacctttccgtttgcatggagacttgttactgaattaaatacttgtttctctgcatgctgttacttacatagttcatttgcattttatttgcttagctctagttaaattagaatgatatattccagcattagtttatcatgcttgtgttttattttgtaataaaaattccatatccaatcatttgactgtcactaacttgtactctttttttcataatacttgtagcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaa

SEQ ID NO: 52136 - DNA, 1767 bp, Homo sapiens
cggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagggatttgcttcctaaggagaagaacttggaaactctgttgaccttggcttttctagaaatagataaagccttttcgagtcatgcccgcctgtctgctgatggactgtggcttattcatttttgaatctccagtgtgcagcaccctgcatagaacctggcagcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaa

SEQ ID NO: 52137 - DNA, 1622 bp, Homo sapiens
cggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggtgacccagagcttctgcctgaaaagtcccaaggagaaggaaggaaaggacagtccaggcattgtgttttagcttttgagtgttgcagtgaattttacacttgattccataatatttccaattataaaatttttatttccccaagttaaaattttaatatgccaaggaaatgtgctttgtttattctttggctttgtatataccttgaaatgatagtaacagcaatagtaaattataatagtaaactaatattcacttgc

SEQ ID NO: 52138 - DNA, 757 bp, Homo sapiens
ccacatctctttgtcccattagttgagatgacttgcagtagaaattgtccacaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggtgacccagagcttctgcctgaaaagtcccaaggagaaggaaggaaaggacagtccaggcattgtgttttagcttttgagtgttgcagtgaattttacacttgattccataatatttccaattataaaatttttatttccccaagttaaaattttaatatgccaaggaaatgtgctttgtttattctttggctttgtatataccttgaaatgatagtaacagcaatagtaaattataatagtaaactaatattcacttgc

SEQ ID NO: 52139 - DNA, 2206 bp, Homo sapiens
cggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaa

SEQ ID NO: 52140 - DNA, 2266 bp, Homo sapiens
cggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatggactgtggcttattcatttttgaatctccagtgtgcagcaccctgcatagaacctggcagcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaa

SEQ ID NO: 52141 - DNA, 1814 bp, Homo sapiens
cggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccagggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaa

SEQ ID NO: 52142 - DNA, 1736 bp, Homo sapiens
cggggaggctcgttcccatcggcatctgtgactggctgcgatcgagggcccgggcggccggccagccgtctcgccgagtgcggactggccggatctgctgtcagtcagcgggaacagacttctccctctccatctggtcaactgcgggagaaaaattttcgagaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagggatttgcttcctaaggagaagaacttggaaactctgttgaccttggcttttctagaaatagataaagccttttcgagtcatgcccgcctgtctgctgatgtgtgcagcaccctgcatagaacctggcagcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaa

SEQ ID NO: 52143 - DNA, 1341 bp, Homo sapiens
ccacatctctttgtcccattagttgagatgacttgcagtagaaattgtccacaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaa

SEQ ID NO: 52144 - DNA, 2238 bp, Homo sapiens
agcccgggagttcgaggctgcagtgagccaacatcgcgccgctgcactctccagcctgggcaacaaagtgaggctctgcctcaaaaaaaacaaaacaaacaaaaaaaaaaaaacacgaaaggcatagagaagttaagtacctagtctgagatgacacagctagtaaggccaagtctgtttagaagtcaggcggtctggccacactacttttcgctcacgatcccgggtcatgaaatccaataacactgtcacactcacaatcgagaagtccagaaagaacaaatacatgcacattgtctctgacaaaactgcaaggtcagaatcaaacagccacgagaatataaaacgcgaccatggtcacacaaaaggtcgcatattcgcacgacctcagatgtcactggacagggtctctcgccctggaaaccccactccaaattccatggccgaagtttcacacatacagtcacactacgtcactcctccctcttctagccgctgtcaggaccttaaggctccagctgacccggccttcactggccctggagctctcaccaccttcaccccgctgtattctagcctcaggtagagacccaaaaagacggaactaaacacactgagccgggcttccttcacggaccttgcgaacctgcagctccagccgactgtaagaaggaagtgcctttttgcaggtggggtcggggaagtagggccgcgaaggcctctgggaaatgtagttcggcgcaggaagcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtgagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagctctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaa

SEQ ID NO: 52145 - DNA, 2063 bp, Homo sapiens
agcccgggagttcgaggctgcagtgagccaacatcgcgccgctgcactctccagcctgggcaacaaagtgaggctctgcctcaaaaaaaacaaaacaaacaaaaaaaaaaaaacacgaaaggcatagagaagttaagtacctagtctgagatgacacagctagtaaggccaagtctgtttagaagtcaggcggtctggccacactacttttcgctcacgatcccgggtcatgaaatccaataacactgtcacactcacaatcgagaagtccagaaagaacaaatacatgcacattgtctctgacaaaactgcaaggtcagaatcaaacagccacgagaatataaaacgcgaccatggtcacacaaaaggtcgcatattcgcacgacctcagatgtcactggacagggtctctcgccctggaaaccccactccaaattccatggccgaagtttcacacatacagtcacactacgtcactcctccctcttctagccgctgtcaggaccttaaggctccagctgacccggccttcactggccctggagctctcaccaccttcaccccgctgtattctagcctcaggtagagacccaaaaagacggaactaaacacactgagccgggcttccttcacggaccttgcgaacctgcagctccagccgactgtaagaaggaagtgcctttttgcaggtggggtcggggaagtagggccgcgaaggcctctgggaaatgtagttcggcgcaggaagcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccggagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagctctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaa

SEQ ID NO: 52146 - DNA, 1951 bp, Homo sapiens
agtccggagtagaaaaggtcgcggcgtcgcagtgtctggcagcagcggtgcagctccgcgcagggtttgtaacacggcctcctccccaccaggtcctcccacactggcctctccccggccttccagagagcccgaaagtccggattccctgcagctccgagcctggcccggtcacagggacggggcccagcgtcacactacacgggctggtgtggaagtgcgcaggcacaagcgctctgcgcgcctcccttagcaaccagggcggggagttgagaatcgcaggttggccgcagggaaaaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtgtatgaacctgcgtgcaaacgtgcatgacagtgggatcttgaatgaatgaaaaactgtggatacaagagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagggatgtaaacagctggaaagaactttgcttcaatcattacaacaaggaaactacaaaacttctaccgtacaacaaggaaatggacaaactacaaaataatttttctaggacccttcagagaactgaggtcacagggcaaccaagtaatcttaaatctggggaaagaaagatgccagctgagagaaacaggactcaagctttacttacctgggatggactctgccagacaccatataagccactctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaa

SEQ ID NO: 52147 - DNA, 2006 bp, Homo sapiens
agcccgggagttcgaggctgcagtgagccaacatcgcgccgctgcactctccagcctgggcaacaaagtgaggctctgcctcaaaaaaaacaaaacaaacaaaaaaaaaaaaacacgaaaggcatagagaagttaagtacctagtctgagatgacacagctagtaaggccaagtctgtttagaagtcaggcggtctggccacactacttttcgctcacgatcccgggtcatgaaatccaataacactgtcacactcacaatcgagaagtccagaaagaacaaatacatgcacattgtctctgacaaaactgcaaggtcagaatcaaacagccacgagaatataaaacgcgaccatggtcacacaaaaggtcgcatattcgcacgacctcagatgtcactggacagggtctctcgccctggaaaccccactccaaattccatggccgaagtttcacacatacagtcacactacgtcactcctccctcttctagccgctgtcaggaccttaaggctccagctgacccggccttcactggccctggagctctcaccaccttcaccccgctgtattctagcctcaggtagagacccaaaaagacggaactaaacacactgagccgggcttccttcacggaccttgcgaacctgcagctccagccgactgtaagaaggaagtgcctttttgcaggtggggtcggggaagtagggccgcgaaggcctctgggaaatgtagttcggcgcaggaagcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtgagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagggatgtaaacagctggaaagaactttgcttcaatcattacaacaaggaaactacaaaacttctaccgtacaacaaggaaatggacaaactacaaaataatttttctaggacccttcagagaactgaggtcacagggcaaccaagtaatcttaaatctggggaaagaaagatgccagctgagagaaacaggactcaagctttacttacctgggatggactctgccagacaccatataagccactctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggttagtggaagggaaccagacaggtgaggagaggtcagggcctattaatgattaatcagtgaatggttgatccctctaaaatattcttcaaagatattttcagaggttggcacagtggttcatacctatagtcccagcactttgggaagccaaggtggaaggattgcttgagtccaggagtttgggaccagcctgggcaacatagtgagacctcatctctta

SEQ ID NO: 52148 - DNA, 425 bp, Homo sapiens
cgaagccacattttcttgtcctttagcctggttttcctgggccagcctcaatttttgggtggttctttgttcctagtatgtatgcccaaatctatgtaacttccctttgacaggctatccgttcaccaaacctgatgtgattttcaaattggagcaagaagaagaaccatgggtgatggaggaagaagtattaaggagacactggcaaggttagtggaagggaaccagacaggtgaggagaggtcagggcctattaatgattaatcagtgaatggttgatccctctaaaatattcttcaaagatattttcagaggttggcacagtggttcatacctatagtcccagcactttgggaagccaaggtggaaggattgcttgagtccaggagtttgggaccagcctgggcaacatagtgagacctcat

SEQ ID NO: 52149 - DNA, 2479 bp, Homo sapiens
agcccgggagttcgaggctgcagtgagccaacatcgcgccgctgcactctccagcctgggcaacaaagtgaggctctgcctcaaaaaaaacaaaacaaacaaaaaaaaaaaaacacgaaaggcatagagaagttaagtacctagtctgagatgacacagctagtaaggccaagtctgtttagaagtcaggcggtctggccacactacttttcgctcacgatcccgggtcatgaaatccaataacactgtcacactcacaatcgagaagtccagaaagaacaaatacatgcacattgtctctgacaaaactgcaaggtcagaatcaaacagccacgagaatataaaacgcgaccatggtcacacaaaaggtcgcatattcgcacgacctcagatgtcactggacagggtctctcgccctggaaaccccactccaaattccatggccgaagtttcacacatacagtcacactacgtcactcctccctcttctagccgctgtcaggaccttaaggctccagctgacccggccttcactggccctggagctctcaccaccttcaccccgctgtattctagcctcaggtagagacccaaaaagacggaactaaacacactgagccgggcttccttcacggaccttgcgaacctgcagctccagccgactgtaagaaggaagtgcctttttgcaggtggggtcggggaagtagggccgcgaaggcctctgggaaatgtagttcggcgcaggaagcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtgagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagggatgtaaacagctggaaagaactttgcttcaatcattacaacaaggaaactacaaaacttctaccgtacaacaaggaaatggacaaactacaaaataatttttctaggacccttcagagaactgaggtcacagggcaaccaagtaatcttaaatctggggaaagaaagatgccagctgagagaaacaggactcaagctttacttacctgggatggactctgccagacaccatataagccactctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaa

SEQ ID NO: 52150 - DNA, 1496 bp, Homo sapiens
gatcgtgtccgtaagcggatttcgtggaggcgctttcccttttatctttcagtatgaacctgcgtgcaaacgtgcatgacagtgggatcttgaatgaatgaaaaactgtggatacaagagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagggatgtaaacagctggaaagaactttgcttcaatcattacaacaaggaaactacaaaacttctaccgtacaacaaggaaatggacaaactacaaaataatttttctaggacccttcagagaactgaggtcacagggcaaccaagtaatcttaaatctggggaaagaaagatgccagctgagagaaacaggactcaagctttacttacctgggatggactctgccagacaccatataagccactctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaa

SEQ ID NO: 52151 - DNA, 2716 bp, Homo sapiens
catacctggtagagaaaaagcttagaagctttatttttatttattatccttggaaataataaaaattatttcaaatagtgcagcaaaacatcccaaagtgatttatttagagtaaaatatacttttctgataatggattacaaaaatcaataccagaggtacaagattattaatttttagaaagaggaaacacatatgttctatagcattttgagatgtgctccttaatggactaggattctgttggcaatgcctttaggcacagggtcagagaggacccaatgagaagggagcattttgtttcttgcctcctccccctatcaaaccagattagtttgcttttgtctcttgtatattggtattttatcaggatttcatttggagggcgaaaaagtactgccatcttgaaagtgattgctatagatattaagtgagatgactataatatggaaggcttaaggataaattccttcttaggttacatttcaaaaaagaagctgtgcagtgttgtagttaagcccgcccgtttagatatgttccttcacttctctgtgcctatttcgtcatctgcaaagtgaaacgatcatagaacctacctcatagagttgtgttacaagatgcaatgagtcaacaggcagaaagcactcagaacagtgcctgagacatgagttctttgtaagtgtttgatatgatggctgcttagttatctccctggtcgtgaaatcatagctttagattctgggtctagaatgggaggacccacggagaccactgggttcaagtctcttgttttagaagtgaagaaactggggcccatagagaagtgactggcctaggggcacagggtgaatttttggcacttagtgacacctcttaacccatggcttgtaaaaaggcacaaacaatgcctttgttttctgagtatctcgcaaatggcatggcttgatgcacctaccttgttctgttttacatgcttgttttggggtcatcttaacaaactctactttcattcctcgtgccagtttcttccctgaccatggtcttgctttaaacactgacttggacagagggatttgaaggccactccaagagtgggctgcatcctcagcctctcccctgctccacacactgcatctcaccaaacggatgtgtttaaaatgaggtgcgcttatggagagaaagtaactcagggccaagcgatcatgaaatttgttgtcgaattattttaaaattaaatgtgatcaatctctacagttgaatgtcagtgttaacagactgatgtggcttgctgctccagccttgggcatgctccatactggtcttcccttctggctccaccagcagcaagcaggatgtctcaggggttgaggatactaccatcagcaggtcttggttgaatacaggctagcctccctgagatttgacttccttcactatgaaatggggataaagaatagtttctatttcatagaatcattggaaggactaattaaggtaatttgtgaaaatgcttagcctagtgcatagtaagtgctcaataaatattagttatatcatcattgttttgtgctcttgtagaaagacctggacaaagactctccttgtgtccttctgtcagatgaagtctgtcactctgctagtaaaggggcccttgtcagactgaataacaatgcaagcctgaatgtttacattagtgttggtcaaagtcagggttcctgctccatctatatctaaatacactagggtgcttgttaacaaatgcacatttctggactcaaacccagaattatggagtcagaaattctaagggcacggccctggaatctgcattttaagtatgctccttgggtatgctgtttctgcacaatgaagtttgagaaccactggtctagataattcaatctgaagagcttggcttactcaggtatcaaggcctcagactccactcacttttctggggcctgttggggtattttgacaatgcatcagaaatagcattgaatctgttgcctggctggctcagctggactgttaggcctgagaaccacagggagcttcccacctggtcttgctgctttagatgattggagcatgcaggtttagggagctgaaaggacacatgccaggcccacagcagtgagcaacagaacagaccaatggaaccaggttgcctgagacagcgccctctaccaagcattttctttggttttgggactggcagtccaaaccgctaaaccagtctgtgtaggtacagtatacacacagctgcagcatgaccccacttcctaggatggtagaggggaggcaggggctcccagccacacagccactgcctccaacgctctctgtccctagctccactgcatgcggttagctggagtctggaaatggctgggggtgtctggttctccagaggagccctgcccagctgccgggtgtgaggaggttagagaaccaacctcattctcgcagtgctctggcagttcatctcttgcaaatactcttaaaagggagagcctggtcaaggtcactatgatttaaattcctcgtctttgaattattcagccaaaagagcctggagattaaccaaaccaacttaggccttcttttaaagtcaagaacagtagccaattttactaaatccaagtattgaaagttacttaattcctctgtcaaaatttaaatgatggcgaccattttggaggaaaaaaaaaaa

SEQ ID NO: 52152 - DNA, 2662 bp, Homo sapiens
catacctggtagagaaaaagcttagaagctttatttttatttattatccttggaaataataaaaattatttcaaatagtgcagcaaaacatcccaaagtgatttatttagagtaaaatatacttttctgataatggattacaaaaatcaataccagaggtacaagattattaatttttagaaagaggaaacacatatgttctatagcattttgagatgtgctccttaatggactaggattctgttggcaatgcctttaggcacagggtcagagaggacccaatgagaagggagcattttgtttcttgcctcctccccctatcaaaccagattagtttgcttttgtctcttgtatattggtattttatcaggatttcatttggagggcgaaaaagtactgccatcttgaaagtgattgctatagatattaagtgagatgactataatatggaaggcttaaggataaattccttcttaggttacatttcaaaaaagaagctgtgcagtgttgtagttaagcccgcccgtttagatatgttccttcacttctctgtgcctatttcgtcatctgcaaagtgaaacgatcatagaacctacctcatagagttgtgttacaagatgcaatgagtcaacaggcagaaagcactcagaacagtgcctgagacatgagttctttgtaagtgtttgatatgatggctgcttagttatctccctggtcgtgaaatcatagctttagattctgggtctagaatgggaggacccacggagaccactgggttcaagtctcttgttttagaagtgaagaaactggggcccatagagaagtgactggcctaggggcacagggtgaatttttggcacttagtgacacctcttaacccatggcttgtaaaaaggcacaaacaatgcctttgttttctgagtatctcgcaaatggcatggcttgatgcacctaccttgttctgttttacatgcttgttttggggtcatcttaacaaactctactttcattcctcgtgccagtttcttccctgaccatggtcttgctttaaacactgacttggacagagggatttgaaggccactccaagagtgggctgcatcctcagcctctcccctgctccacacactgcatctcaccaaacggatgtgtttaaaatgaggtgcgcttatggagagaaagtaactcagggccaagcgatcatgaaatttgttgtcgaattattttaaaattaaatgtgatcaatctctacagttgaatgtcagtgttaacagactgatgtggcttgctgctccagccttgggcatgctccatactggtcttcccttctggctccaccagcagcaagcaggatgtctcaggggttgaggatactaccatcagcaggtcttggttgaatacaggctagcctccctgagatttgacttccttcactatgaaatggggataaagaatagtttctatttcatagaatcattggaaggactaattaaggtaatttgtgattgttttgtgctcttgtagaaagacctggacaaagactctccttgtgtccttctgtcagatgaagtctgtcactctgctagtaaaggggcccttgtcagactgaataacaatgcaagcctgaatgtttacattagtgttggtcaaagtcagggttcctgctccatctatatctaaatacactagggtgcttgttaacaaatgcacatttctggactcaaacccagaattatggagtcagaaattctaagggcacggccctggaatctgcattttaagtatgctccttgggtatgctgtttctgcacaatgaagtttgagaaccactggtctagataattcaatctgaagagcttggcttactcaggtatcaaggcctcagactccactcacttttctggggcctgttggggtattttgacaatgcatcagaaatagcattgaatctgttgcctggctggctcagctggactgttaggcctgagaaccacagggagcttcccacctggtcttgctgctttagatgattggagcatgcaggtttagggagctgaaaggacacatgccaggcccacagcagtgagcaacagaacagaccaatggaaccaggttgcctgagacagcgccctctaccaagcattttctttggttttgggactggcagtccaaaccgctaaaccagtctgtgtaggtacagtatacacacagctgcagcatgaccccacttcctaggatggtagaggggaggcaggggctcccagccacacagccactgcctccaacgctctctgtccctagctccactgcatgcggttagctggagtctggaaatggctgggggtgtctggttctccagaggagccctgcccagctgccgggtgtgaggaggttagagaaccaacctcattctcgcagtgctctggcagttcatctcttgcaaatactcttaaaagggagagcctggtcaaggtcactatgatttaaattcctcgtctttgaattattcagccaaaagagcctggagattaaccaaaccaacttaggccttcttttaaagtcaagaacagtagccaattttactaaatccaagtattgaaagttacttaattcctctgtcaaaatttaaatgatggcgaccattttggaggaaaaaaaaaaa

SEQ ID NO: 52153 - DNA, 879 bp, Homo sapiens
  misc_feature (17)..(17): n is a, c, g, or t
  misc_feature (738)..(738): n is a, c, g, or t
cggcgctcggcgaggtnggttggcggcctgctctccgacagaacttttcttcttgggttgaggaaaacgcctttggagtcaggccctggaggggcgagccttgctcacaggtcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagttccatgtgancaacacacaaaaactgttggggggcggccccgaaaaatttaacattcttggggcgggccgggagaaaggcacgtccaagaccggcctgcacggggtttccaaaaaccgggccaggttaaccagagggggctggctccgccc

SEQ ID NO: 52154 - DNA, 836 bp, Homo sapiens
  misc_feature (17)..(17): n is a, c, g, or t
cggcgctcggcgaggtnggttggcggcctgctctccgacagaacttttcttcttgggttgaggaaaacgcctttggagtcaggccctggaggggcgagccttgctcacagggtggggatacagccgattacccgccctgtgctttccgatggcttctgcggggcgagcggggcctggccggggggtgcgggcgggagggcgagccagcggcgcctgcagcccgggccgcgtaacgctgaccgctgtgccttcagtcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcaggtatctgttctactgttgcagcacgtttctgtttgtgaattttgctaaaattgcttgtatttagactgcattggtagttggagtcatgaaaacaatccttttatgaatccaattgggtagaaagataaagtacaggcagagcgccgtggcttaggcctgtaatcccagcacggggaggtggaggcgggtggatcactgtagagaccagcctgggcaacatggtaagaccctgtctacaaaaaatggaa

SEQ ID NO: 52155 - DNA, 545 bp, Homo sapiens
aagcttgcggccgcgcgcgtgttgggcccggggtgctcggacgcgcgctcagggtcggtcctgctgttcgttgcttcttaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcaggtatctgttctactgttgcagcacgtttctgtttgtgaattttgctaaaattgcttgtatttagactgcattggtagttggagtcatgaaaacaatccttttatgaatccaattgggtagaaagataaagtacaggcagagcgccgtggcttaggcctgtaatcccagcacggggaggtggaggcgggtggatcactgtagagaccagcctgggcaacatggtaagaccctgtctacaaaaaatggaa

SEQ ID NO: 52156 - DNA, 817 bp, Homo sapiens
gagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagaagcctcacgggccacgatgttcattcctgaattccccagagtatccatttgtaaaccaaacaatgacttacattacaaaagctttactcctcacagtacaacacacaacaacacaacacacaggcactagttctaaaagcga

SEQ ID NO: 52157 - DNA, 641 bp, Homo sapiens
gagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagttgggtactacgctttggcaggc

SEQ ID NO: 52158 - DNA, 588 bp, Homo sapiens
  misc_feature (502)..(502): n is a, c, g, or t
  misc_feature (507)..(507): n is a, c, g, or t
  misc_feature (515)..(516): n is a, c, g, or t
  misc_feature (518)..(518): n is a, c, g, or t
  misc_feature (544)..(544): n is a, c, g, or t
  misc_feature (564)..(564): n is a, c, g, or t
gagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagcccggtacntcttnacaagctnntncacggattgccaatcccttttaaggnactttgggttttcccaaagncgaaaatttgttgggccaaagagg

SEQ ID NO: 52159 - DNA, 747 bp, Homo sapiens
gagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaatgactaattaaagtttttcccaaaaaaaaacaaaaaatttgggggccgcagaattaaactttgggcggcagtaa

SEQ ID NO: 52160 - DNA, 730 bp, Homo sapiens
gagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaatgactaattaaagtttttcccaaaaaaaaacaaaaaatttgggggccgcagaattaaactttgggcggcagtaa

SEQ ID NO: 52161 - DNA, 662 bp, Homo sapiens
cttggcgctcgaactgaacatggctttctcctgggagaacttgccgagcgccggcttaggaagagacgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaatgactaattaaagtttttcccaaaaaaaaacaaaaaatttgggggccgcagaattaaactttgggcggcagtaa

SEQ ID NO: 52162 - DNA, 802 bp, Homo sapiens
gagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaatgactaattaaagtttttcccaaaaaaaaacaaaaaatttgggggccgcagaattaaactttgggcggcagtaa

SEQ ID NO: 52163 - DNA, 717 bp, Homo sapiens
gcggccgctactactactactactaccctcgcggcccgtcgatcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagactccggcagggatgtcaattgattccagagttcatgtaacaaccttgctactaaacagttttttcccgtacaccaccacacaccacacaacacccca

SEQ ID NO: 52164 - DNA, 819 bp, Homo sapiens
  misc_feature (17)..(17): n is a, c, g, or t
cggcgctcggcgaggtnggttggcggcctgctctccgacagaacttttcttcttgggttgaggaaaacgcctttggagtcaggccctggaggggcgagccttgctcacaggtcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaatgactaattaaagtttttcccaaaaaaaaacaaaaaatttgggggccgcagaattaaactttgggcggcagtaa

SEQ ID NO: 52165 - DNA, 769 bp, Homo sapiens
gagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagactccggcagggatgtcaattgattccagagttcatgtaacaaccttgctactaaacagttttttcccgtacaccaccacacaccacacaacacccca

SEQ ID NO: 52166 - DNA, 692 bp, Homo sapiens
gagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaaggacaagtgaacttctgtgtctataagaagctcacgttagttcattgtaacaaaatgactaataagaagtataag

SEQ ID NO: 52167 - DNA, 676 bp, Homo sapiens
gagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcaggtatctgttctactgttgcagcacgtttctgtttgtgaattttgctaaaattgcttgtatttagactgcattggtagttggagtcatgaaaacaatccttttatgaatccaattgggtagaaagataaagtacaggcagagcgccgtggcttaggcctgtaatcccagcacggggaggtggaggcgggtggatcactgtagagaccagcctgggcaacatggtaagaccctgtctacaaaaaatggaa

SEQ ID NO: 52168 - DNA, 517 bp, Homo sapiens
ctctctggggggggattaggggtaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaatgactaattaaagtttttcccaaaaaaaaacaaaaaatttgggggccgcagaattaaactttgggcggcagtaa

SEQ ID NO: 52169 - DNA, 621 bp, Homo sapiens
ttgttcttcttcaattatggctcactgaagcttgactgccccaggcttaggtgatcctcccacttcagcctcctaagtatctgggacaataggcatatgccaccatgcctgcctaatttttaagattttcaagaagcaggaactggccagttcctgcttcttgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaatgactaattaaagtttttcccaaaaaaaaacaaaaaatttgggggccgcagaattaaactttgggcggcagtaa

SEQ ID NO: 52170 - DNA, 766 bp, Homo sapiens
tacaaacagggtttttttttaaattaattaatttattttttgccacccaggcttatctcaaacttctggcccccatcaatcctcccacctcagccttccaaagtgttgggattacagtcatgggccactgcatctggcttggatcttttgctgacctcaaaatgttggacatcctcaaagttgatacctagacttcatccatactcacttccccaaattatataattatgtcacttcatgtgccactttaagcttaaatgcaagcttatttctccagctttcacctctcttttaaatacctcttatgtacttaactgcattcgggtatctaatagacatcttaataaacatcttaaacttaacatcaggtgtttaacaggcatcttaaactcaaacagatctcttgatcttccacctgtactaccaccaccacaaaacttaacctattttcccccacaacttctccaattcaggaaatgtcactaccattcttccagttgctgtggccaaaaatctaagagtcatacttaattcccctctctctccttttgcactttctatttaatccataagcaattcctattaattctactttcagaatttatactaaagtctgaccacttcatatcaccagcactgtctaatcttagccactatctttactctcctacactaaattcccactaacgttctccctgcttttctttcacttctatactgctttcctcacagtgtctgagtgatattgtaaattaagtaagaattg

SEQ ID NO: 52171 - DNA, 2039 bp, Homo sapiens
  misc_feature (779)..(779): n is a, c, g, or t
ctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccnatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcaca

SEQ ID NO: 52172 - DNA, 869 bp, Homo sapiens
taattgtgggtgcaaggaagaatgaggaagaagtgtaaggacttaaatgagtttaccagggttaggaatgggagaagatttgaccataaaagggagtgagggcataagtaaatttctttttcttttttcttttttttattttttgccacccaggcttatctcaaacttctggcccccatcaatcctcccacctcagccttccaaagtgttgggattacagtcatgggccactgcatctggcttggatcttttgctgacctcaaaatgttggacatcctcaaagttgatacctagacttcatccatactcacttccccaaattatataattatgtcacttcatgtgccactttaagcttaaatgcaagcttatttctccagctttcacctctcttttaaatacctcttatgtacttaactgcattcgggtatctaatagacatcttaataaacatcttaaacttaacatcaggtgtttaacaggcatcttaaactcaaacagatctcttgatcttccacctgtactaccaccaccacaaaacttaacctattttcccccacaacttctccaattcaggaaatgtcactaccattcttccagttgctgtggccaaaaatctaagagtcatacttaattcccctctctctccttttgcactttctatttaatccataagcaattcctattaattctactttcagaatttatactaaagtctgaccacttcatatcaccagcactgtctaatcttagccactatctttactctcctacactaaattcccactaacgttctccctgcttttctttcacttctatactgctttcctcacagtgtctgagtgatattgtaaattaagtaagaattg

SEQ ID NO: 52173 - DNA, 854 bp, Homo sapiens
ctcgactctgaggtgcattctttttttgatgagaggcatctctaggtaccatccctgacctggtcctcatgctgccgaggctgttgctgttgatctgtgctccactctgtgaacctgccggtgagttgcacttccttttcttcttcaaggtctgtgggtattttgttacttaggtcagcacaggaggcctgcagattgctgtcttagcagccccttcctgcccaaaacatatcagggtgacagctgctgaggtgtacaaacatcagtggctcccttgggcctgggctgctctgtcttcacatcagtctctgcacctgacacgtgtctgctcagtggggtgaacaggtcttgctctgaccttctcaagaacacagtcttacttccgggaagtcccagcacagggagggagacactgtttgcacaaggaaggcaaagggtgctgaagattcatgctagaagcatctctgtcctcccagcctcaggagctccaattcccagttgtgcttctcagctgggtgtgtcaccatgggtgatgaaggaaatgccaaaatcacacatccacggagaacattagagagaatcctccagacatgtgtggaatgaagtagtactgctgcctccttcctatttttagctctcctctgcagccacacctgttaccccagctcattttctctttcggactctggtttatgcaaacttacttcattgcactggtcctgattcaaagtcttacctttaccaaagaaggagagtaagcaatccctttccccacgaaggactcttcactagatcaagctcaatgataaaatgtaaaaattgctatcttgtgcagaaaatactagcacagacca

SEQ ID NO: 52174 - DNA, 984 bp, Homo sapiens
ctcgactctgaggtgcattctttttttgatgagaggcatctctaggtaccatccctgacctggtcctcatgctgccgaggctgttgctgttgatctgtgagtcagggtcttactctgttgccccagctggggtgcggtggtatggtcatggctcattgcaaccttgaattcctggtctcaagtgatgcacctgcctcagctccctgagtagctggaaccagagacacatgcaaccacactcagctaattaaaacaattttttgaccaggcttatctcaaacttctggcccccatcaatcctcccacctcagccttccaaagtgttgggattacagtcatgggccactgcatctggcttggatcttttgctgacctcaaaatgttggacatcctcaaagttgatacctagacttcatccatactcacttccccaaattatataattatgtcacttcatgtgccactttaagcttaaatgcaagcttatttctccagctttcacctctcttttaaatacctcttatgtacttaactgcattcgggtatctaatagacatcttaataaacatcttaaacttaacatcaggtgtttaacaggcatcttaaactcaaacagatctcttgatcttccacctgtactaccaccaccacaaaacttaacctattttcccccacaacttctccaattcaggaaatgtcactaccattcttccagttgctgtggccaaaaatctaagagtcatacttaattcccctctctctccttttgcactttctatttaatccataagcaattcctattaattctactttcagaatttatactaaagtctgaccacttcatatcaccagcactgtctaatcttagccactatctttactctcctacactaaattcccactaacgttctccctgcttttctttcacttctatactgctttcctcacagtgtctgagtgatattgtaaattaagtaagaattg

SEQ ID NO: 52175 - DNA, 701 bp, Homo sapiens
ctcgactctgaggtgcattctttttttgatgagaggcatctctaggtaccatccctgacctggtcctcatgctgccgaggctgttgctgttgatctgtggtgagttgggcaactcagagcagggcatgggatgcaatcatgcttgggctctgcttcctgaagggctgtaaggacttcttaggactaaggttctgtcaggtaatgctcaggggtgctcagatctccacttccacggagggctcagagtcaggcaaaaagttgtagatatttcaaaaagccagagttttcaagaaaactatcatttcagtttttatctcataggaagtgttcactgtctgtcttcctttccatcaataattgtctttgttctcagtgttttcaacagctgccaaaagaaaaatctgtataataaataggcctctgaattccttgcccttcttactaccaacgttatttccttttatccctctctgactccccattcccacagtcaaaccttagaacttatcatcactcctttgttttcagcatacatcccccacccccactaagttgtgtttctagctcactttctcctgcactctatttccaacatgacttcaattaccccagggctacttttccattatcagtaactacacttcatgtgctcacttctcatggtgctcagctcagattctgcagctcaccaccacaacact

SEQ ID NO: 52176 - DNA, 445 bp, Homo sapiens
tattttactcaatttctcaggggcatttgatcactctttattttttgaaacacttttaatttggcttctggaatatcatattctgctggctttctttctaattcagtatctgctacttttcagtttctttgctaaattatttaatttttttagagtcagggtcttactctgttgccccagctggggtgcggtggtatggtcatggctcattgcaaccttgaattcctggtctcaagtgatgcacctgcctcagctccctgagtagctggaaccagagacacatgcaaccacactcagctaattaaaacaattttttgaccaggtatggtggctcatgtctgtaatcccaggactttgggaggccaaggtgggtggatcacctgaggtcaggagttcagaccaagctgaccaacatgatgaaacccagtctctactaaagaaaaaa

SEQ ID NO: 52177 - DNA, 2922 bp, Homo sapiens
  misc_feature (779)..(779): n is a, c, g, or t
ctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccnatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaagtctctatagtagtgtgttatatagataaatcataacttttttctttttttattgtagtaaatatgcacaacataaaattgatcattttaaccatttttaagtgtacaattcagtggcattaagtactatcataatatattttaatccttctcatcactggtggacattaaggagactctcaaaaaattcatattataaaaacaaagttcaaacaaatgtctttgtactagcatattatggcactcctgctggattatctgaaggataaatttgtaaatctagtattgctagattatgcatattaaatattcttgttaaatagtca

SEQ ID NO: 52178 - DNA, 2342 bp, Homo sapiens
  misc_feature (779)..(779): n is a, c, g, or t
ctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccnatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgtggtcccggctacttgggaggctggggtgggatgactgcttgagcccaggaggttgaggttgcagtgggctgggatcgcatcactgaactcaagcctgagagtcagaacatgaccctgtctcaaaaaggtaaaaa

SEQ ID NO: 52179 - DNA, 396 bp, Homo sapiens
cacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacaggtatagctcaggctatggaactgtcttggtcaatgtctccttcccagcgtcctgggagagttttgctggtgccactgtgcttccgggggtttgctacccatggtggggcctctgtgtgaggtgctgtcatgagtgatgtattggaggggcatggagaactcaaggttgggtgcagctcttctcttgtcataaagatgataagccacaagtccctagacaaataaataaatccccacttg

SEQ ID NO: 52180 - DNA, 2655 bp, Homo sapiens
  misc_feature (512)..(512): n is a, c, g, or t
ctcgactctgaggtgcattctttttttgatgagaggcatctctaggtaccatccctgacctggtcctcatgctgccgaggctgttgctgttgatctgtgctccactctgtgaacctgccggggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccnatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaagtctctatagtagtgtgttatatagataaatcataacttttttctttttttattgtagtaaatatgcacaacataaaattgatcattttaaccatttttaagtgtacaattcagtggcattaagtactatcataatatattttaatccttctcatcactggtggacattaaggagactctcaaaaaattcatattataaaaacaaagttcaaacaaatgtctttgtactagcatattatggcactcctgctggattatctgaaggataaatttgtaaatctagtattgctagattatgcatattaaatattcttgttaaatagtca

SEQ ID NO: 52181 - DNA, 2653 bp, Homo sapiens
  misc_feature (510)..(510): n is a, c, g, or t
ctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacagggctcccagggcccaggctgcagtggaggatgtgctggagcttcactgtgaggccctgagaggctctcctccnatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaagtctctatagtagtgtgttatatagataaatcataacttttttctttttttattgtagtaaatatgcacaacataaaattgatcattttaaccatttttaagtgtacaattcagtggcattaagtactatcataatatattttaatccttctcatcactggtggacattaaggagactctcaaaaaattcatattataaaaacaaagttcaaacaaatgtctttgtactagcatattatggcactcctgctggattatctgaaggataaatttgtaaatctagtattgctagattatgcatattaaatattcttgttaaatagtca

SEQ ID NO: 52182 - DNA, 223 bp, Homo sapiens
atagtgtgttcatcacactgtttaatgttcttgcagagttttataggctaataaattttcctaggaaatgattgaagtcagggaggtttgtgattgactttagtcatttcctaggaaatcattgggaatgattttccaaaccctttgtttggttattttaataagaatcttttagagccatgcccaatggaatggacgaaaacaatgagaaggaagggaaatt

SEQ ID NO: 52183 - DNA, 326 bp, Homo sapiens
agtagagagggtttcaccatgttggtcaggctggtctcaaactcctgacctcaggtaatccacccgccttggcctccgaaagtgctgagattacaggcctgagccgccatgcttggcctatgatttagatgttcctgtctgtttgggtgacagcccctgggtgacagtgtctgaatctagataatgtggctgtccctgggggccacaatgtgcctgcgtctgtccctgtgcaaatcactggaggtgaagagggaccgtgacaatgtgtgtgtcggtaagcgtggggtgacagtgtgcctgtgtgtcattgctcagactgtcccctg

SEQ ID NO: 52184 - DNA, 1569 bp, Homo sapiens
tttctatttccacccaccatgagcatttttcatttcatgctgagccttttgggttcaggccctggtgacaaaaataaagtcagccccccagaaaaagcagatcagctaaaaatctctatatgggacttgtattgatacacaatgtgaccggacctgaatctccccagaatccgcaccagcttcccaatccctccctgctctgtcactgatttaatccaactgagaaaattttcttaactagggtccttagggatccccagaattaatagtgcctgtaaacttgaatgggaaaaaaaataagtcttcactgtcttctaaatgctaatgctaaaatttagcatttcctttcataatgaatgtaggtaacaaaacacagctgaattagtccttgtcacaaatattttcacatcacattgcagttgttgcagttactgttgcttattttttgtagcagttatgttctataaagttgccatgaacactgaattagcacatgctgaaccattgtccttaggggaagtacaaggctaggttcctgtgagcctgcagtctcaacattttcaccaaccaatcaatatataactgttttccgtgtggcttttgttcaaaagacaccgtatttaatatacagtggattcattaacattgaccgcacaggcaacagcactgtaactcctgcctgcaaagagctcatctaccactggggtgattttcttggtgcggcacgttgcagtcttctgtggcacatcacttagcagcactagctagcacttcagcactgcccttcatggccattttaaacagcaacatcaccgggaaaaagcatgaaatgccaaaaatgtggcactaagtatactgcgaagaggacacaggtttgcagtatgagagctgaaacaagaaggcaaaacttgaccggtcgcagtggctcatacctgtcatcccagcactttgggaggccgaggcaggtggatcacctggaggtcaggagttcgaaaccagcctggccaacatggggaaacaccgtctctactaaaaatacaaaaattagctgagcgtggtggtgtgtgcctggcatcccagctactctggagactgaggcaggagaatcacttgaacctgggaggcagaggttgcagcgagccgaggtcatgccattgcatgccagcctgggcaacaagagcaaaactctgtctcaaaaaaaaaaaaggcaaaacttcactttgccaaccaatctcatctggggaacatgccagttgggcaactcaaatttgtcattggtctgtgcatgggcacagatgactgcaaaggcgccacaagtatacattaatgttacaaataaattttagcaaggaggtgaattcacaaatatgtgatcagtgaacgatgccgatcaactatatcttatactttaaaacatcaataccttaaaacaactgtagttattagaaccaactctggatctggttattaacacgttcaaaaagaagcccatatatttatatatgctcatttgtgaatatctcaaaatattctttgatattctatttcaatagaattggttttcttcgt

SEQ ID NO: 52185 - DNA, 364 bp, Homo sapiens
  misc_feature (323)..(323): n is a, c, g, or t
tttctatttccacccaccatgagcatttttcatttcatgctgagccttttgggttcaggccctggtgacaaaaataaagtcagccccccagaaaaagcagatcagctaaaaatctctatatgggacttgtattgatacacaatgtgaccggacctgaatctccccagaatccgcaccagcttcccaatccctccctgctctgtcactgatttaatccaactgagaaaattagctgggtgtggtggcacacacctgcagtcctagctgcttgggaagatcacttgagcccagcaggaggtcgagggagtgagcccagactgcancgctgcactccagcctgggggatagaatgagaccttgtctc

SEQ ID NO: 52186 - DNA, 850 bp, Homo sapiens
caaaacagcgctacaggaaatttagaaaatgaaacaaaaatcacccactatttcttcagcaggcagtgactgtgttagcattttggagttcactgccagtcttttccccatccttttccttcattgtcgttgtcactggagtgtgtgtgccgtgacaccttttttcatttaatactgcgtctgtgggcattttctcatggtgctacgcggtctaagtaacgttgcttctaaaaagctacagaacattctaggctggcctgctgcagcgccatcacccatacactggagcgtgtgcatttttcccctctgttgctgttgtggttgtcgttactatgagtcccaaaagcagccagggtgttggagggcacaagcaacttggcacccaactgaatgtgggttccaggcccagacatgccacttaggcccagggtagagggaccttagacaggtcactgacctgctgagcctcgttgatataaataacaggatggtaacacctacttcagaggaaggtgtaaggacagtgtcaactaactaaccaagggactctaaagtgcctggcacagccctttcttcactccctctgtgagtaggattggcattgttgaaggagtgcccactgctggctgcctcaacctgtggggaaggtgcctgagccacgggccaatgttgactgaccactcacctggcaaagaggtggtctccgcctgaggagcccctgtgaaaccccctggccctgaggttctagaatactatggccagtgcccttgcctgccttcccttctccccattaccatatgattggctggcctaggacatggggctggccctgggaagatgggctgctggt

SEQ ID NO: 52187 - DNA, 359 bp, Homo sapiens
ctgcaacagctgcagcgaggactctgtgaggtcacgtgggaaggagcttggcacagtgtcaaggacgcctccttgaactgagcttaggactctggagatgggtggatcaagggtctcctgctcccagaacctctgctttgtgatcctctttagcctgtgttttcatcaaaatgtgacctcctattgggctcttctaggaacaaacactggaactgcatcagagtcctcagcatggagccagccgcataggtggagctctgtgaatgttgatagaatcagagtaagaaaggagaggatggcactggaccccatgatgcaagcatcctccagacacgtcagcactggcagcctgggagaag

SEQ ID NO: 52188 - DNA, 984 bp, Homo sapiens
acaaccctgctcgaagactatcagtgcttccccttttccaagttcggattcctaatcctactatctaaggttctccctgatccagtcttatctccactaacaccatagaaggtcacaatgttcagatgagtttccatttctagctgttttcctaaacttctcttgcagtttttgactccatcaaaaattctctattagttctcatactgctataaagaaatacctcatactgggtaatttataaaaaaaaaaaaagaggtttaattggctcatgcactgcaggctgtacaggaagcatgatgctagcatctgctcagctgctggggaggcctcaggaagcttacaatcatggcggaaggtgaagggggagctaggcaattcacatgtccagagcacgagaaagagagaggggaagtgctacacacttttaaacaaccagagctcatgagaactctattgcggggatagcaccaaggggacggtgctaaaccattcatgaaggatccacccccaccatccaaccacctcccaccaggccccacctccaacattgaggttatgatttgacacgagatttgagcaggaacacagagccaaaccctatcagctcttttgactcctcccttctccatctccacctgttagagttatacctttcttcaacatctagctaaaactactttcaccatgatacttctgatttctcctgtcaaaaatgccttgtatgcaaaagcattccgcaccatcccgggagcatttaccatggtctgcaccaacaaagtacatattttatctcctcttttagatcacaagccttgtaagaggagaggctgagcatcaggatttcctggagaacatgaactttgaaaactaaataaccaggacttgttttcacttcgactgacgctctccggttttaattccctcatctgtaaaaaagaacctacgataattattgagaattgatttgcttacctcagaggt

SEQ ID NO: 52189 - DNA, 112 bp, Homo sapiens
accaagcccatcagtgctgagttcctatctacagtggttgagtcttctggatactggctcttgagccacagggccattctcccggatattcatcgggtcttgacgattacct

SEQ ID NO: 52190 - DNA, 388 bp, Homo sapiens
aaactcacccttctcttcactagaggaagggtggtgggagaggaaataacttcttctgcagcctagaggtgagacccagaggaccacaggaatgggcctggagggcaagtggccatagctgagactttaaaccagagaagaaagagggcaaggaaaccagatcagtcaccaatgctaatgtcctctgggcatgtcaacactaagaagatgaaaatggaaaacatgaaaaggaagtatcacttctggcttatgttatgtacttggcacagtgttaatttccatccttgcaccttccccgtgcccttctctgcttcacaggggcctaattaacattacacagtgtcctataggcctcagatgaaagctattataaaagtgcagaaacggt

SEQ ID NO: 52191 - DNA, 234 bp, Homo sapiens
ctggagaatcaaaaatgtcaatcatggcaaaacaatgcaacaaggtgtatacgatatatatatatatttttgatatggaatctcactgtgttgcccaggctagagtgcagtggcacagtctcagctcactgcaacctccacctcctggattcatgcgattctcctgcctcagcctcctgagtagttgggattacaggtgcctgccaccacacctggctaattttttgtattttt

SEQ ID NO: 52192 - DNA, 1037 bp, Homo sapiens
caggagagcgacatcttcctgagctcctgtccatgcctgccatacctgccagcttcagacatttagggaaaaggggcagcatgtggggaatgccccccgccttccacaaatccttttgctgacccaggaagttctgggagttgccgtttttcatcaaaacgtttgggggcttccaagttgtttgtgagatctgaaaacttaactttgcccaatatcctggttggggaccgtgagaaatatctgtcccatttagatctctggggccactgatgggatgccctgggaagatccttggctgccgctttctctccccacagcctcaaggccaccctaccgtcatatatatcactcaggcgtagaagaaaagacacatattttataaaatctttttaataaaaggaagttccaagaagaatttttaagaactacctctaggtgtgcctccacgctggccctagctttcccattgctgttccattgctgagacaaactggaaggctccctttctgtttgaagttttatgacttgtagtcaggctttgctgttcgtcacagtgtcattttccattcaggtaccatcacctggtcccatcaacaggtctagtatgtagctcactgataacagaggaagatgtgtctcctcccaccctcttcctaatggtcattatgcctttctccatctattgtctctttcaccccttcccctctcccttgggctctgatgaaaaattgttgactgcagtttcggaagtttgatctgagaaccaaccatagaatgtttcagttctaggaaataaaaccagttgattaaagcaaaaaaaacaaaaaaaacaaaaaaaaaaaaaaaaaaaaaagacaagagagagagaacagaaagagacgagaaggagagaagacccatacaaagaaagtgaatccacaaaaacgaatgagagagcaaccacaagcagaagaaagaagcagcaacacaacaaagttgggagccccacaaaaaggaggggccctccattatcgaatacgcgaccagtcgacatggcg

SEQ ID NO: 52193 - DNA, 845 bp, Homo sapiens
atgtgatacaactgtgtgcaaacacacggactttatttctctgtgggcatatatgtaaatgtacagaaaccagcctggaagaaggcatgccacactgatgacagcatctgcctctaggggaacacggcggagggcctggaacaggcaggggtactcaaggtccattttcaccttactgactgaaattttatacagagaaaaatacattcagtaaatatttttttaaaagtttaaaaattcacttaaagaaaaaaggtcattgtagtggaagtggcaaataaatgccagttaatgtttttcatacttaggaataaaaagagtagaatgatttcctaaaaagggccatggatggcaaatgtagagactatgggcaattccctgaagtgtattccttagaaatcaaacagtgcctcccacacatagatacaggcatcctctgtacctcgactttatcttaccagagcagctgccttccaggattttgtaatggtcttagaaaatcaatccctacaaacatgcagttagaggggaaaaaatgacataaaattgcatgttttacggtaaatctaaagtacttctttacctcccacttggaagttttaggcagtttcattccttaatgtttctatagcacccaaagtggcaattctcgaggacggagccaaaaccaaaaccacacctgcccacatacctgcaggaaaggagtgggtaaggagccccggctgctggtgggatgctatatccctcagctgtgcaaggcagcaaacaggattaagacctgttaattctaagtctagctttagtattaaacactatcatctatccaaaaaaaataattcattgat

SEQ ID NO: 52194 - DNA, 436 bp, Homo sapiens
gacacacttgtcaaccaagatatgcaggtacttctggaaggcgaatcccatcaaacctccttccaaatttaagaatggagctgggtagagctatgtgggtgtgcagtgcttcccaccaaccaaaccactcaggacgctgcttccccagtgatcagcaccagagtttacctggcactttccacctggccatgtctgcaactcagagcagaggctaagggagtccgcctgcacaggacattcagaaacacgggagggtttcaaggttcacgcctctttggcatttcccaggctcccctcacggtgtcggcagtgcccacatcgcaaacttcaggagatgggagcgagaggggcctgttgggtgaccaagctgtcatggctgctgggttccctctttgctgcctgtcagcctcacccctgggcatcccccacctgctgg

SEQ ID NO: 52195 - DNA, 700 bp, Homo sapiens
gcgttgttaaacaaaccaaaaaactatcatttaatatatccacctttctacttagactccatcttgataagaattatattggcccattggacacattttctcccaagaatttaaactgtgaagtaagggatgaaaggatatgtgtcaatgtttgaaggaccaggcagggctgtggcatgtctttgcctgtgattcctatcaattattgtatcctggtttcagttttctagttctcttttgagtgggttcttatattctttcaggaaagtttatttttgctaataatggccagtgtcaatttccagtgctcacaagcaagaaccatgctttcagaaggttggtataagaaggctactgccattctcatgagacttgtaggactctttgacagtagagaaatcacagtagaaaaatacaacttctattgtttgccctgtatgttgcttccctttgatagcagggactcacattaaatgaagccaagaagttacattagagcctttgctgcccaatatgatattactagtcacagatgactgttgaaacctaaatttaaattagaattttaaaaaatttgttgctagtgactatcatattggaaggcacagattgtagaatatttccaccatcaaagaaagttctatcagacaacactgttggagtataaactcaagggtaggcattctgtccttgttatttt

SEQ ID NO: 52196 - DNA, 1134 bp, Homo sapiens
cttcccaacttaatgactcaaaaaaaaaaacaaacactatcttcatagttgtatgggtgaggggaaacttggctggctagttgagcagttctaagtctgcagtcctctaaaggcttgcttgacgatcaaggatctacttccaaggtgtcacactcacataattggcaagttggtgctggttgttggtgggaggcgatagtcctccccatgtgggtctctctatgaggctgcttgagtgtccccacatgatggcttactctcagagcaagctaccaaaggcagcaaggcagaaaccgtaacatcctttatgactttgtctggaaatcatacactgtcacttctgccatattatgtttgtcacacagacagctctcattccttgtgggagctgacttcgaaaaggcatgaatatcaagaggcaaatcaccagggctcatcttgaaggctggctgccatgctgctcccttcatattgatgatgtagtacacatctttgggaggctgaagaatggtccctaaaagatagcagggcctaattcccagaacctgtaaatgttatcttacatggaaatgttatcttatatggaaaaagggtctttgcagatttaactaaattaaggatattgaaatggaaatattattctgagttgtccaggtatgccctaaatgcaatcagagtctttcaaaaagagtacaatggacagaatgtttgtgtcctcccaaaattcctatgttgaaaccctaacccccaaagcgataatgttgggagctagagactttgggaagtaattaggtcatgaggttagagcactcatgaattaaattagtgcccttaaaaaaggaccccagaggccaggagtggtggctcacacctgtaatcccagcactttgggaagccgaggtgggcagatcacttgaggtcaggagtttgagactagcctggccaacatggcaaaaccctatttctactaaaaatacaaaaattagccagatgtggtggcacgtgcctttaattccagctactcaggaggctgaggcatgagaatttcttgaacccaggagatggaggttgcaggaagccaagatggcaccactgcactccagcctgggtgataaagcaagaccctgtctcaaa

SEQ ID NO: 52197 - DNA, 761 bp, Homo sapiens
ttttaatgggctttaatttactcctcataggcctgatgtctagagagttaccagggcttctggaggaaagtctagtattgaatgtttctaatttcatgttatttgctcgattgtagaattttggagagctttgattgaaaagacttggtgatggggtattttagtcaaaaactagccggtgaaggtaaaacgttgaattcatgtattccacggagatttagaaaggtattgcgtacctgagaataacatttcatcatgcatcacctcctccctacacccactgtatttgtgtaaatcaataaataatgattggatgttagatgtgttgtgtttttatgtttgtgtcatcgtgcgtttgacttttagagattgtaggatgtttgagcaagtaagaagctaactgctgtgaggtccccagattatttcacagtctgtagtttgattcttgtctgtatagattactttgagaagggaaagcaatctcccttctagagtcatttcaggtcattgtttgttttctgccaagtgtcattttctctgttctttaaacctagttcgtgattttcaatccaggcaccgcggtgcagtgtaaagataaattccattcccagtgtgacgtgtgtactgatttcataatgtttttatcctgcatgattctgttcaattaggaattgttcaccgatgagaaagtgtggtgataacttagcgttgcttatggaaaacctggttggttttgttcagtgtctctggggtgggggaag

SEQ ID NO: 52198 - DNA, 608 bp, Homo sapiens
tggtaaagagacatcagctttctcaccatggctgtttcataacacaaggagacctggcccaagctcagaggggaaagacccctgggtgttcatggaaaacctttaagcacagtgagaccaaatgttagtagatgggggataaaagggagaaattcatggagtatgcctagaacaggccttgtatgcagcatccccttcttgcctagggacttgaagggccaggcttcctgtcattgcctcactcaaatgtagcccaggaagacattagactgatagcactgatcacctccagacaaaacccctgcacctgcacagtcacatagacttggacaaaagcccatccttactaaggaagacctaacaactatttcttctcacgcccattcttgtccaccgtctttatcaaaaagccaggaaaactgcttcttcagacactttctgagccggctgtattttgaaggacaaaaaaaaaaaaattactcttttgagagcattgtgtctgcaaggtgggctcacgttatttttggtgatcagtttatgactggagttcaaatagactgcttattttataagagtttttaattttgaatattctttttgctgaactg

SEQ ID NO: 52199 - DNA, 537 bp, Homo sapiens
gggtattttaaaagataagaaatttgctgagaattccttaaatttttctaattttcacttgccagtgaggtcattgtcccttttttgcaggtagctttgaaagatgatgatatctccacagctgagaccatgttgttaaaacatccttcatttaaccatttacacatttggttctaaagttcttggttctaaagaatgtgttatcttgagattcttgtcttattactattcttaaaattgctctaaaacttgctgaggtaatcagctttaaattctgtaaatacagataacaaaaccctcttaatcctaaaggtgcttttaaagttcatgtatttatacatgtatgcaagttgcctgttaaactgggaagattttattctaagtaaccaaatcttaaggagctaaagcaaacctgttttataaaatatattaattccaggactaagcaatttctgaaaacagactgatttactgtgctgcttaatatttcctcaaactagaatacaagcgacggtggcagagggaggaagtaactca

SEQ ID NO: 52200 - DNA, 266 bp, Homo sapiens
tgggaggccaaggcaggaggattgcttgaggccaggaatttgagaccagcctgggtaacatagtgagaccctcatctctacaatatacatacatatatatatatatgtatgtatatgtgtatagatgtatatattaggccggtggcatgtgcctgtagtcccatctacttggcaggctgaggccagaggattgcttgagtccagtcatggcagtaagccatgattgtgccactgtgctccagcctaggtgacagagatcctgtctc

SEQ ID NO: 52201 - DNA, 612 bp, Homo sapiens
atacaatgggatatataatgggatattttgttgccatttaaaattacttacaagaatttgataatctggaaaaatacttctgatgttaaacaaatgaaagcaggtattaaataatttctacagaatgatctcaatagatgggtagaaaaaagactgaaaggaaattggactaattattaacagtgattgcctctggatgggtaggattttttctgttttcattttctcagttgtctacaataagcatatattactttaatggtcaagaaaacaggaaggaaaaaaactggaatgagagggaatataaactggaaatcccctatgagctgtgtacagaagtggatgccattaataaatgtaaggagggcatctgtctctaagtagtggcatgccatgcaccttgatatgtcattcaggaccagtagctgcttaggtgtatggatcggagcctccaaacctcgctcactttgaatgccagcgttcgctttattgcatctctctctctcagatctgagacctaaggatgtgttcctggagaggagagcacacatcaagtgaggggagtctggctctgctcccctttattgcccagagcgtccaggcagaccagtc

SEQ ID NO: 52202 - DNA, 267 bp, Homo sapiens
cccctggctgccctcccctcctccttcctcagtgtgactccacgctggaaggtgacacattcccaagaggcctcttggacttttgtgaccctgagactacgtggaagctgacagcagatcagggctcaagcgatagttagaagtggtggctgttccgtgcgtgggcacccccacccccaccccaccaacctcagcatggaagggaggaggggaacggaaaacagtaggagaaacacctgagggagcccatgagcccgggactgatgc

SEQ ID NO: 52203 - DNA, 762 bp, Homo sapiens
aactatacctgatatatgttaagtatttggttgagtcactctgagtacactgcttgtcttgttgctatggttactgctgccttgtgggggtacaccgtgtatcatttttgtcatggactttatttattagcacagacaactctttcttctattatttacgtggttctccctcgttcattattttttaatgtttttcattgttgatttgttttctttttttgaatactttttagttgatgcatttttttcttcacattttgactgccaagttttcagtgattttgaggttcagaaaaagtcagattataaaataatcacaaaaaaattaataaagtaaacaagaagtatttaaagaaagtagaaactaaacagagagagaagtttcctgagttttttagatataggtattttgatgacatttttctcttttatttgcctttagaaagagataattaaaaaataaaaaccaattttccccagtggtgatagattgttatacactcttgcctagtttttattctgttattatgaaaaacatacttttggccaggcgcaatggcccatgcctgtaatcctagcactttgggagcccaaggcaggcagatcacgatcaccttaggtcaggagtttgagaccagcctggccaacgtggcaaaaacccatctctactaaaaatacaaaaattagctgggcgtggtggcatgcctgtaatcccagatactcgagaggctgaggcaggagaatcgcttgagcctgggaggc

SEQ ID NO: 52204 - DNA, 398 bp, Homo sapiens
ttgccgatgggtgcttgtgactggagacagcaactgcaccctctcatttcagcccctcattgaacagcgtctgtgctgctcctctcagcctatggcagctggtttggttgccaggcaatggaaggcagagaccagaagaccttttcttgggaggaagaaaggggagagggaggggagaagcaagaaagaagctcacagcccgaaggcttgctccctcctgagagtctggcccagggctgggggaatgggaatgggggtaaagtcctcacaacccctactttccgtggtttactcctggtggacagccccactttcagagcttgaagccccagagagacggagagggaatgcacgcacctgcacctcctgtgaaggtcagagaaatctgtgactaagga

SEQ ID NO: 52205 - DNA, 1653 bp, Homo sapiens
gccggacgacgggctggtggggtgaacccttcatcctgggtcttttaatttctcaggcggaacgagtggcggcggacagaggcttttggctgcgctgtctgtgggttgtctgggcttggggaactgggcacggagaccgtggcgccggccgccggtcatacagctctgcttccagtcgtcgggcaaaaagctgaggcgcttctcctttaattgcggtgggcggggcgtgccgacgcggcccgcgttgctattggtggccgttgggggcgcggaaactgaacgggccgcaacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtggga

SEQ ID NO: 52206 - DNA, 2040 bp, Homo sapiens
gccggacgacgggctggtggggtgaacccttcatcctgggtcttttaatttctcaggcggaacgagtggcggcggacagaggcttttggctgcgctgtctgtgggttgtctgggcttggggaactgggcacggagaccgtggcgccggccgccggtcatacagctctgcttccagtcgtcgggcaaaaagctgaggcgcttctcctttaattgcggtgggcggggcgtgccgacgcggcccgcgttgctattggtggccgttgggggcgcggaaactgaacgggccgcaacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattg

SEQ ID NO: 52207 - DNA, 2224 bp, Homo sapiens
gccggacgacgggctggtggggtgaacccttcatcctgggtcttttaatttctcaggcggaacgagtggcggcggacagaggcttttggctgcgctgtctgtgggttgtctgggcttggggaactgggcacggagaccgtggcgccggccgccggtcatacagctctgcttccagtcgtcgggcaaaaagctgaggcgcttctcctttaattgcggtgggcggggcgtgccgacgcggcccgcgttgctattggtggccgttgggggcgcggaaactgaacgggccgcaacggccaccgcagctgccttcggcgccgccagccccgccatggctgcgccctgcgcggaagagtgctggccctggggaagccccttcctcacccaggcttcacacatttgaccctggctctctctcaggagggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattg

SEQ ID NO: 52208 - DNA, 1238 bp, Homo sapiens
ctgacttagcaggatccttagacagctggacccccgtcaccggctgctgaagctttatagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattg

SEQ ID NO: 52209 - DNA, 1933 bp, Homo sapiens
gccggacgacgggctggtggggtgaacccttcatcctgggtcttttaatttctcaggcggaacgagtggcggcggacagaggcttttggctgcgctgtctgtgggttgtctgggcttggggaactgggcacggagaccgtggcgccggccgccggtcatacagctctgcttccagtcgtcgggcaaaaagctgaggcgcttctcctttaattgcggtgggcggggcgtgccgacgcggcccgcgttgctattggtggccgttgggggcgcggaaactgaacgggccgcaacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattg

SEQ ID NO: 52210 - DNA, 872 bp, Homo sapiens
  misc_feature (58)..(58): n is a, c, g, or t
  misc_feature (129)..(129): n is a, c, g, or t
  misc_feature (137)..(137): n is a, c, g, or t
cccagccaaactggccagctccatggggaatctgggcttccctggcaccgagaccgtntctgggaactggttctatggctggccaaagtaactcaaccccatagggagcccaggagaactgcagccatntctcaggngctaacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattg

SEQ ID NO: 52211 - DNA, 2184 bp, Homo sapiens
gccggacgacgggctggtggggtgaacccttcatcctgggtcttttaatttctcaggcggaacgagtggcggcggacagaggcttttggctgcgctgtctgtgggttgtctgggcttggggaactgggcacggagaccgtggcgccggccgccggtcatacagctctgcttccagtcgtcgggcaaaaagctgaggcgcttctcctttaattgcggtgggcggggcgtgccgacgcggcccgcgttgctattggtggccgttgggggcgcggaaactgaacgggccgcaacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattg

SEQ ID NO: 52212 - DNA, 1861 bp, Homo sapiens
aaggctggtgtgaatcggacgaggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattg

SEQ ID NO: 52213 - DNA, 2012 bp, Homo sapiens
gccggacgacgggctggtggggtgaacccttcatcctgggtcttttaatttctcaggcggaacgagtggcggcggacagaggcttttggctgcgctgtctgtgggttgtctgggcttggggaactgggcacggagaccgtggcgccggccgccggtcatacagctctgcttccagtcgtcgggcaaaaagctgaggcgcttctcctttaattgcggtgggcggggcgtgccgacgcggcccgcgttgctattggtggccgttgggggcgcggaaactgaacgggccgcaacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacaggaatctcaaaattaaacctgaattcaatgcaaaaaaaaaa

SEQ ID NO: 52214 - DNA, 1917 bp, Homo sapiens
gccggacgacgggctggtggggtgaacccttcatcctgggtcttttaatttctcaggcggaacgagtggcggcggacagaggcttttggctgcgctgtctgtgggttgtctgggcttggggaactgggcacggagaccgtggcgccggccgccggtcatacagctctgcttccagtcgtcgggcaaaaagctgaggcgcttctcctttaattgcggtgggcggggcgtgccgacgcggcccgcgttgctattggtggccgttgggggcgcggaaactgaacgggccgcaacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagaaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattg

SEQ ID NO: 52215 - DNA, 2295 bp, Homo sapiens
agtcgctcaggctactcccaccccgccccgccccgtcattgtccccgtcggtctcttttctcttccgtcctaaaagctctgcgagccgctcccttctcccggtgccccgcgtctgtccatcctcagtgggtcagacgagcaggatggagggctgcagaactggctcaggaaagccctcctgggatggctggagtggaaaatgaggatgaggcagagctgaatctgagggagcagggtggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcctggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctggaaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcctccaggaggaaggggaggagagcagagaagagagcgaggaggatgagaggaggggagggagccaggggctgggcggtgggggccagggtcttctgttggcagcctccaggctctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaa

SEQ ID NO: 52216 - DNA, 989 bp, Homo sapiens
aaataggcaggtacgggctgggtgttaattcggacgagcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaaaaaaaaaaaaaaaaaaaaaaaaaaaaaaaaaacgcgcggggtccttttgcggggggggaaacagacgggttaaaagcgggcagtggcgcaatgggtttcctggagcccgttttttgtacagggggagaatcgggggccccaaagaggggggagtaatctgaaacgcggctcattctatttctgtagatggtagataggatacgaagacaggggtttgtggcgcgcaataatatattgagaactgtggtagcaaaaacaactaagggtgttgaagcaacaacaatcagagtgaacggcaacaaattaaagtgacaaccaaaaacgcactg

SEQ ID NO: 52217 - DNA, 363 bp, Homo sapiens
atatgactccccgcaccctaagtccccagtgacgggcagatggtcttttcctagtcctcccctgtaggaccaggactctctgtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaa

SEQ ID NO: 52218 - DNA, 4152 bp, Homo sapiens
ctgctacccttgagacacctgtgccagcctttcttaagaaccaagaattcctccaggcccgtacccctaccttggccacggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcagggtggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcctggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctggaaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcctccaggaggaaggggaggagagcagagaagagagcgaggaggatgagctcggggagacccttccagactccactcccctgggcttctacctcaggtcccccacctcccccaggtgggaccccactggagagcagaggccacccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggctctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaa

SEQ ID NO: 52219 - DNA, 2803 bp, Homo sapiens
agttcgacggagactctctagtgaaatggtttttttaaaaaaaacatttcactaaagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcagggtggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcctggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctggaaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcctccaggaggaaggggaggagagcagagaagagagcgaggaggatgagctcggggagacccttccagactccactcccctgggcttctacctcaggtcccccacctcccccaggtgggaccccactggagagcagaggccacccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggctctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaa

SEQ ID NO: 52220 - DNA, 490 bp, Homo sapiens
acgaatcgagctcggtcccccccgactagcccgacagtgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaa

SEQ ID NO: 52221 - DNA, 4260 bp, Homo sapiens
ccatcccccccacacctcaggcaccctctccttctgtagatgcagagatcagagcccaggatgctcctctctctctgctccagacacagggtgggaggaaacaggctcccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcagggtggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcctggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctggaaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcctccaggaggaaggggaggagagcagagaagagagcgaggaggatgagctcggggagacccttccagactccactcccctgggcttctacctcaggtcccccacctcccccaggtgggaccccactggagagcagaggccacccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggctctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaa

SEQ ID NO: 52222 - DNA, 4466 bp, Homo sapiens
ccatcccccccacacctcaggcaccctctccttctgtagatgcagagatcagagcccaggatgctcctctctctctgctccagacacagggtgggaggaaacaggctcccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcagggtggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcctggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctggaaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcctccaggaggaaggggaggagagcagagaagagagcgaggaggatgagctcggggagacccttccagactccactcccctgggcttctacctcaggtcccccacctcccccaggtgggaccccactggagagcagaggccacccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggctctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaaaaacaacctgacacagagccacacaaaaaacacaccacaacaaaaaaagagacacgagggaactacaattaggagggagtagcagaaaaccagcgggtaacagaaaaaagtgcaaactagagacacaccaaacagagagcaagcggaccacagcagtctatgaagtacacaacaaaagggaaaaaagtcagtgagctcatcacaca

SEQ ID NO: 52223 - DNA, 4267 bp, Homo sapiens
  misc_feature (4253)..(4253): n is a, c, g, or t
ccatcccccccacacctcaggcaccctctccttctgtagatgcagagatcagagcccaggatgctcctctctctctgctccagacacagggtgggaggaaacaggctcccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcagggtggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcctggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctggaaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcctccaggaggaaggggaggagagcagagaagagagcgaggaggatgagctcggggagacccttccagactccactcccctgggcttctacctcaggtcccccacctcccccaggtgggaccccactggagagcagaggccacccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggctctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtcggggctgtcgggctagtcggggctgncgggctagtcgggg

SEQ ID NO: 52224 - DNA, 862 bp, Homo sapiens
ttaagtgctttatcttctgagatagtatttatcttcattttaccttttctttttttttttgagacagagtcttgttctgtcacccaggctggagtgcagtggcgtgatcttggttcactgcaacctttgcctcctgggttcaaacgattcttatgcctcagcctcccaagtagctgggattacaggagagtgtcaccacgtctgtctaatttttgtgttcttaatagaggtgaggtttctcaccgtgttggccaggctggtttcaaactcctgacttcgagtgatccgcctgcctcagcctcccaaagtgcctggccatttatcttcattttaaagatgagaagactgagactcagaaaagtcaagtaacttatagagcataggaacataagtcatagagcagataaatggagccagagcccaaatttctgtactcaaagcttgtatacctcattcttagttataccaaatatattttgtaatcgtagttattattctttgtttctctgaaaatttttacattttttgagtcacagtgtttttccccctttttttctgattgttgaaacagttgggatattattcataacagaaagaactaaggtttcattgagatggtctttggattagtttgttgaccttgatattggtgacttgggaatgggtgataccttagctgagcaggtgatttatcagcaatctgataagacaatctctgctttaaatgctttctgggggcctgggtgtggtggctcactcctgtaatcccagcactttgggaagctaaggtgggagggatcgcttgagtctgggcgtttgagaccagcctgggtaacatagtgagaccctatctctacaaaaa

SEQ ID NO: 52225 - DNA, 388 bp, Homo sapiens
ccttcaatagtgaaattttgtcttgagtaggaaaaatatttatgaacagaaagtcttcttagggattgtctgtttataaaatttattcagtattcatggaattggtaagatgagtgcccactgtatgccagatactgcagttaaacttacagatgaataacttacattgcttattcatacttacagatgaataacttacattttgaggatccctgcaatgacgggaaaggaccgaaacaaacagaaattaatagttacagtacaggccgggtacagtggctcatgcgtgtaatcccagcactttgggagctaaggtgggagggatcgcttgagtctgggcgtttgagaccagcctgggtaacatagtgagaccctatctctacaaaaa

SEQ ID NO: 52226 - DNA, 311 bp, Homo sapiens
tgtaagaatgataagaaaaccaagattctgcataggaattttaaaataccttaaagtatataaagatatattccttagaatggaaatacactatatatattaagaaaacattttggccctcactttttcctcttcattaaaggtcactttttttttgtcttggatctgttgagattatcttgatactagtaacctgctaaaatatatctgtagttttattctaaaatttgaatttttttcatacatcacatcaaattaaaaagcttctgcacagcaaaggaaacaatcaacaaagtaaagagacagcccac

SEQ ID NO: 52227 - DNA, 292 bp, Homo sapiens
tgacaagctttctaaacatgaccctttatttcaacatgaagataaagaggcaaagctatactgattgaacagaaaacaagaatgggacttaaaaaaaaaaacaagagttggatagacagtgttcttccttctagttgataggaaggccacacagtgtaaaactatactcacaactttggtgttcacatgcacaatcttcaccacttagaaagaagcagctttattagtgcttataaaaattcattagtccctataaaaccagaaccaattcagcagataagtaaataaaaca

SEQ ID NO: 52228 - DNA, 398 bp, Homo sapiens
ccagatgactgctaatggcttttcctagtgtgctattgtattttcataaaaacctaccaaaataaaaccgttgggggtagttttgcctagaggcagaggcttaacagagatgacctctgaccccgcgactggattctctgttctgaatctagcaattcctttgggaaggattcctctggggatggtcttcatgtaccaggcaccttaccaatcatttctggttgtgtcacaggatacaggactcttttatcagaggaagggggatttaggtctgatgagggtagagtgtttctggctggggcagcgggccagaggacgccacagttggtctctataatgggaaggaggtggaagccgagggaaacggagactgacctgtcatctctccttggcctcga

SEQ ID NO: 52229 - DNA, 426 bp, Homo sapiens
tctgaatgggttggtgaaaggttacaggagcagacagcctccacacccaggctgctcttggctatacaggctacctccatccctgaatgttgtaataggaaagtctaaacacacagaagaggagcacaaaaccaataattatcacacattcaaaataaaactaatccataaagaaaagtaccaaactcaacaaagacagcaatgcctgaaaacactgggctgtatcagcaaatagaacaaagaaaaataagcataattaaaacagtagaaggtgaaggataatttttaaaaattagatatcatattctgattattgaaataaaaaacttagtagaaaagcttaactgaagaagaatcaaaactgaagaagaacccagacagttatgaaaatgaaaaagcaaaccaaagactgggaaaaaatatttg

SEQ ID NO: 52230 - DNA, 278 bp, Homo sapiens
ggtaagcctttaggggatgtgtttttgttttgttttgtttttaatctcccactgatttccactgacaattctagcatccctaaacacttgtctttctctcactttccgcctaaccagcagcatcattagttattttacatctttttattgaagctgtcatggactcccagatgccttcctttttggcaagtagaaagaacactgcactctaaaggatttaattcactttctcctcccgagtctcctgatgaagctttaggcaaattgcctaacttatc

SEQ ID NO: 52231 - DNA, 398 bp, Homo sapiens
cactgacaggtgtcccagcagagtctatgaatcctgcttttcttgagaaacctggaactctccaaaaaggggagagaagtaggcatgcatttcaaatcccttgtaaaatttgggaaaggcttgagtaactccttaagagagagcataacgattaattttagaatctggacctgctgttctggtgaacattctgtaatcagagattccacaaccacattggccagagcctgggcttggggttacacggagctgagttcaaatccctgccctggaatttatgagccatgtgacattgggtaagtaatgtaattgcttgtaattacttgaaaataataataatgggttgttgtgtagattcaatgaccaagctatttgcaaagcatctgggtggtgcatga

SEQ ID NO: 52232 - DNA, 461 bp, Homo sapiens
gtgacaatccccctttttgatgatctgaatctctgacttattgattatggaacctgtcaagtagttttcaactctcccagtgaggataattaaacatgctcagcctgagccacctgtaagtgaggccctcagcaagccctggccccaactcggagtcctccagtgatctccggagctagttccctgccctcacaccctgtctggtacccgagaagaaagcagggccaggccagaagctggtgtccaacagacaccacctgtcaaagctgcctttcacagggttccacctcccagactcactctgggacccagaatcctatatgtggccttggggtaggtgacaatccccctttttgatgatctgaatctctgacttattgattatggaacctgtcaagtagttttcaactctcccagtgaggataattaaacatgctcagcctgagccacctctaagtgtc

SEQ ID NO: 52233 - DNA, 1296 bp, Homo sapiens
tatttttcttctttgttttcttaagactctctcccctgcagcgccatcagctcagggagccacttgatcttggtcactgctccatgccggagcctgggaaggagcctggcccaggtcgccggttcaatgaatgcgtgcggaatgaatgaacgactctagtgaaagagactccaatgacgcaggccgggatttgcggagcacgagccccgcgccgcgaagcattctggggattgtagtttctccgtgacgcggtgactcgcagagcactgacgcactctgcgcccggaggacagagcggcccggtcgccggcatggtttctccgtcctgctgcagccggcgggaggcagccagtccaggcgcccgctagcttcggcggcgacccagacggggaaagcggaaggaatgtcgcgtggtgggtccgggtcggcggtgcagggagccccggggcggaatgcgggggatgccaggacctccggaaggaggtgccggagcccaggaagcgttttcttccccatttaccgagtatagctcctttccccagacccgctcccgctgctctgacaagcaggcagctggtgtggaagaatggcggtgagccattcagtgaaggagcggaccatctctgagaacagcctgatcatcctactgcagggcctccagggccgggtaaccactgtggacctgcgggatgagagcgtggcccacggacgcatagacaatgtcgatgctttcatgaacatccgcctggccaaagtcacctacacggaccgttgggggcatcaggtcaagctggatgacctctttgtgacaggccgcaatgtccgctacgtccacatcccagatgacgtgaacatcacctcgaccattgagcagcagctgcagattatccatcgggtgcgaaactttggtggcaagggccaaggccggtgggaatttcccccaaaaaactgtaagtgaggccctcagcaagccctggccccaactcggagtcctccagtgatctccggagctagttccctgccctcacaccctgtctggtacccgagaagaaagcagggccaggccagaagctggtgtccaacagacaccacctgtcaaagctgcctttcacagggttccacctcccagactcactctgggacccagaatcctatatgtggccttggggtaggtgacaatccccctttttgatgatctgaatctctgacttattgattatggaacctgtcaagtagttttcaactctcccagtgaggataattaaacatgctcagcctgagccacctctaagtgtc

SEQ ID NO: 52234 - DNA, 1036 bp, Homo sapiens
tatttttcttctttgttttcttaagactctctcccctgcagcgccatcagctcagggagccacttgatcttggtcactgctccatgccggagcctgggaaggagcctggcccaggtcgccggttcaatgaatgcgtgcggaatgaatgaacgactctagtgaaagagactccaatgacgcaggccgggatttgcggagcacgagccccgcgccgcgaagcattctggggattgtagtttctccgtgacgcggtgactcgcagagcactgacgcactctgcgcccggaggacagagcggcccggtcgccggcatggtttctccgtcctgctgcagccggcgggaggcagccagtccaggcgcccgctagcttcggcggcgacccagacggggaaagcggaaggaatgtcgcgtgcaagcaggcagctggtgtggaagaatggcggtgagccattcagtgaaggagcggaccatctctgagaacagcctgatcatcctactgcagggcctccagggccgggtaaccactgtggacctgcgggatgagagcgtggcccacggacgcatagacaatgtcgatgctttcatgaacatccgcctggccaaagtcacctacacggaccgttgggggcatcaggtcaagctggatgacctctttgtgacaggccgcaatgtccgctacgtccacatcccagatgacgtgaacatcacctcgaccattgagcagcagctgcagattatccatcgggtgcgaaactttggtggcaagggccaaggccggtgggaatttcccccaaaaaactgtaagtgaggccctcagcaagccctggccccaactcggagtcctccagtgatctccggagctagttccctgccctcacaccctgtctggtacccgagaagaaagcagggccaggccagaagctggtgtccaacagacaccacctgtcaaagctgcctttcacagggttccacctcccagactcactctgggtcacccttcccagctccagagagggcatcactgagggaggccca

SEQ ID NO: 52235 - DNA, 845 bp, Homo sapiens
tatttttcttctttgttttcttaagactctctcccctgcagcgccatcagctcagggagccacttgatcttggtcactgctccatgccggagcctgggaaggagcctggcccaggtcgccggttcaatgaatgcgtgcggaatgaatgaacgactctagtgaaagagactccaatgacgcaggccgggatttgcggagcacgagccccgcgccgcgaagcattctggggattgtagtttctccgtgacgcggtgactcgcagagcactgacgcactctgcgcccggaggacagagcggcccggtcgccggcatggtttctccgtcctgctgcagccggcgggaggcagccagtccaggcgcccgctagcttcggcggcgacccagacggggaaagcggaaggaatgtcgcgtgcaagcaggcagctggtgtggaagaatggcggtgagccattcagtgaaggagcggaccatctctgagaacagcctgatcatcctactgcagggcctccagggccgggtaaccactgtggacctgcgggatgagagcgtggcccacggacgcatagacaatgtcgatgctttcatgaacatccgcctggccaaagtcacctacacggaccgttgggggcatcaggtcaagctggatgacctctttgtgacaggccgcaatgtccgctacgtccacatcccagatgacgtgaacatcacctcgaccattgagcagcagctgcagattatccatcgggtgcgaaactttggtggcaagggccaaggccggtgggaatttcccccaaaaaactagacaaggtctcactatgttgcccatgctgtcttgaattcctgg

SEQ ID NO: 52236 - DNA, 1147 bp, Homo sapiens
tatttttcttctttgttttcttaagactctctcccctgcagcgccatcagctcagggagccacttgatcttggtcactgctccatgccggagcctgggaaggagcctggcccaggtcgccggttcaatgaatgcgtgcggaatgaatgaacgactctagtgaaagagactccaatgacgcaggccgggatttgcggagcacgagccccgcgccgcgaagcattctggggattgtagtttctccgtgacgcggtgactcgcagagcactgacgcactctgcgcccggaggacagagcggcccggtcgccggcatggtttctccgtcctgctgcagccggcgggaggcagccagtccaggcgcccgctagcttcggcggcgacccagacggggaaagcggaaggaatgtcgcgtgcaagcaggcagctggtgtggaagaatggcggtgagccattcagtgaaggagcggaccatctctgagaacagcctgatcatcctactgcagggcctccagggccgggtaaccactgtggacctgcgggatgagagcgtggcccacggacgcatagacaatgtcgatgctttcatgaacatccgcctggccaaagtcacctacacggaccgttgggggcatcaggtcaagctggatgacctctttgtgacaggccgcaatgtccgctacgtccacatcccagatgacgtgaacatcacctcgaccattgagcagcagctgcagattatccatcgggtgcgaaactttggtggcaagggccaaggccggtgggaatttcccccaaaaaactgtaagtgaggccctcagcaagccctggccccaactcggagtcctccagtgatctccggagctagttccctgccctcacaccctgtctggtacccgagaagaaagcagggccaggccagaagctggtgtccaacagacaccacctgtcaaagctgcctttcacagggttccacctcccagactcactctgggacccagaatcctatatgtggccttggggtaggtgacaatccccctttttgatgatctgaatctctgacttattgattatggaacctgtcaagtagttttcaactctcccagtgaggataattaaacatgctcagcctgagccacctctaagtgtc

SEQ ID NO: 52237 - DNA, 943 bp, Homo sapiens
agtatacggatcacgtgtcctcagcaagccctggcatagttcaccatctttcgggtcctaacacgtgcgctcatgcatctgtgtccacagatacaaaaattgcagaggtggtctgtgctgggaattttgtttgagaacctggtggaggtgagttggcaactgtaccccctaccctgctatagctgccatctgtgtgctcctgtccacagcaagcaggcagctggtgtggaagaatggcggtgagccattcagtgaaggagcggaccatctctgagaacagcctgatcatcctactgcagggcctccagggccgggtaaccactgtggacctgcgggatgagagcgtggcccacggacgcatagacaatgtcgatgctttcatgaacatccgcctggccaaagtcacctacacggaccgttgggggcatcaggtcaagctggatgacctctttgtgacaggccgcaatgtccgctacgtccacatcccagatgacgtgaacatcacctcgaccattgagcagcagctgcagattatccatcgggtgcgaaactttggtggcaagggccaaggccggtgggaatttcccccaaaaaactgtaagtgaggccctcagcaagccctggccccaactcggagtcctccagtgatctccggagctagttccctgccctcacaccctgtctggtacccgagaagaaagcagggccaggccagaagctggtgtccaacagacaccacctgtcaaagctgcctttcacagggttccacctcccagactcactctgggacccagaatcctatatgtggccttggggtaggtgacaatccccctttttgatgatctgaatctctgacttattgattatggaacctgtcaagtagttttcaactctcccagtgaggataattaaacatgctcagcctgagccacctctaagtgtc

SEQ ID NO: 52238 - DNA, 1333 bp, Homo sapiens
tatttttcttctttgttttcttaagactctctcccctgcagcgccatcagctcagggagccacttgatcttggtcactgctccatgccggagcctgggaaggagcctggcccaggtcgccggttcaatgaatgcgtgcggaatgaatgaacgactctagtgaaagagactccaatgacgcaggccgggatttgcggagcacgagccccgcgccgcgaagcattctggggattgtagtttctccgtgacgcggtgactcgcagagcactgacgcactctgcgcccggaggacagagcggcccggtcgccggcatggtttctccgtcctgctgcagccggcgggaggcagccagtccaggcgcccgctagcttcggcggcgacccagacggggaaagcggaaggaatgtcgcgtgcaagcaggcagctggtgtggaagaatggcggtgagccattcagtgaaggagcggaccatctctgagaacagcctgatcatcctactgcagggcctccagggccgggtaaccactgtggacctgcgggatgagagcgtggcccacggacgcatagacaatgtcgatgctttcatgaacatccgcctggccaaagtcacctacacggaccgttgggggcatcaggtcaagctggatgacctctttgtgacaggccgcaatgtccgctacgtccacatcccagatgacgtgaacatcacctcgaccattgagcagcagctgcagattatccatcgggtgcgaaactttggtggcaagggccaaggccggtgggaatttcccccaaaaaactgtaagtgaggccctcagcaagccctggccccaactcggagtcctccagtgatctccggagctagttccctgccctcacaccctgtctggtacccgagaagaaagcagggccaggccagaagctggtgtccaacagacaccacctgtcaaagctgcctttcacagggttccacctcccagactcactctgggacccagaatcctatatgtggccttggggtaggtgacaatccccctttttgatgatctgaatctctgacttattgattatggaacctgtcaagtagttttcaactctcccagtgaggataattaaacatgctcagcctgagccacctctaagtgtcaaaaaaaaaaaaagaacaaaaaaaaaacttgtgggggcgccggccggaggaagttttaaaccttcggttggcgcgggcccagggtaggaccggcacggggccaaagacccggcgaaagggggggtcaccaaaaacccgggacgggggagcaccaggggggccggtcacagcaggcgaaccccgggg

SEQ ID NO: 52239 - DNA, 476 bp, Homo sapiens
tgcagccggcgggaggcagccagtccaggcgcccgctagcttcggcggcgacccagacggggaaagcggaaggaatgtcgcgtggtgggtccgggtcggcggtgcagggagccccggggcggaatgcgggggatgccaggacctccggaaggaggtgccggagcccaggaagcgttttcttccccatttaccgagtatagctcctttccccagacccgctcccgctgctctgagtaagcggtgctcatcccgttttaccggtagcttagctagcttggagaagctaagtggtttgctaagtgatcgccctcctaggaggtggcaaagcctgttctagaacccgggcctgactcgaggtccggtgactgctctttgcagtcgcagcagcagccccatacctttgcttgatcgcagattcatcaggctgcagccgggtggctggtcgttaggccatgcccagggacctagctcccagg

SEQ ID NO: 52240 - DNA, 1675 bp, Homo sapiens
ggagaaggggtatctgaatttcaacttgggggctgggcaaggtaaccagtgaggtggggagataaatagaacttggtagctaagacccttcaggttggcttgatgatgcattgtgatcatggcttctacttcagatgtgttgctggaatagatatccttatacttgtaattcccctatacacaaatgccagcaagaatagtcccattgaggacatgctaaatgtagagaggtagtagtatgacatggaaaacactccccaacttgtctccctgtctcctgcttatgtggtacatggccactgactacagtattaacctttacttgagccctgtgcttctggaaaacagtgacagttaagaaatccctccttcttgttacatttcaggaaatggcttattgcaaagaaccactagaactgtgagtaacaccttcatttacctatgataaagccagactcagaccctccaaatcccattctttgcctcaaaataattagttgaactatttgtacccatagactaatctggacaaaatgccctttaacttgacccaattttatgcttctcccttccccgtaagccactggactttgatccaccttcagcctgagccagcactggactgtggaatagtccctccttttcccctcctgaaaattgactagccaccaggaaggacattccctgctcagctgtcccattaacgtcacctgctcctctcctccacgttagtttttttctagcctgtttattcctccctgtaagagaaaaagagaaaagcctatttctatctgatctttgagatgcttgcagatcttacctttgaagcattctccttattgcaatagtctccctgaccctattgcaatagttcctctctccctgtttgtattcacccattcaggctgctatatatagcaaaataccataagctgatagcttatagacaatataaatttacttcccacagttctgaagcccgggaagtcaaagatcaaagtgctggcaggtctggtgtctggtgggggcaccttctcactgtcctcacatggtagaagaagcaagggaaactcttgggcctctttagaggtactaatcccactcatgaggcctttaccttcttgacctagtcatttttcaaaggctcgacccatcatcattcgtatgttaggatttcaacgtacaaatttgtggggttgggagggatacaagcattcagagcatagcactattttaataatcatttcaaatagagtcattctatacctagtctggatttttgtttgttttacttgacctcattcacttgggtaggaaaaaaatctcatggactctcattgatagccccaggggtaaggttggggcaaaaagagcagaggcactcatttactgtgaggtaagaaatctgtttcagatcaccttgtgtgcaattcaggataaaattaataaagatgaatagtaaaaatccaatactaagagataaaactcaggagtcaaaagaagaaatcagaaagattagagcataattcagaatgtaatgaaaacaaactatgcatagaaacttgtggtattcggccaagacagcatgtaggagaaaatgcaagtattacctttcttgcttgtattaggataaaaagttgaaaattaacaagctaagtatctaactgaaagagaa

SEQ ID NO: 52241 - DNA, 1239 bp, Homo sapiens
  misc_feature (108)..(108): n is a, c, g, or t
  misc_feature (262)..(263): n is a, c, g, or t
  misc_feature (382)..(382): n is a, c, g, or t
  misc_feature (539)..(539): n is a, c, g, or t
  misc_feature (553)..(553): n is a, c, g, or t
  misc_feature (626)..(626): n is a, c, g, or t
  misc_feature (846)..(846): n is a, c, g, or t
  misc_feature (1216)..(1216): n is a, c, g, or t
  misc_feature (1232)..(1232): n is a, c, g, or t
  misc_feature (1238)..(1238): n is a, c, g, or t
accgcaaatccttccccgttccgcttattcatttgccgcttgtgtctggtcttaagtttgcaggtctttccccaaattatgtgttttcatattttgtttggcatattnagataggtaaggttttaattatctttatattagtccattttcttgtggattttaaaatattgctctaatgcttggaaggttctcctccatcttcagatgacataaacatacacctatttggccttttgaaaatatttaactctttaatctagcnncaatttactttgcaatataatataaagatctacattttcccccagtagttaatcaactgtcctagtactatttatcaaatagtttattctttatctattggtttatagctatctatatnatatacatgattttatttgtaggctctcttttccatttcactaatgtgtttgtctatacctgagtcaacactgtgtcattttaattattgtaactttgaagaacttttcaatatctgggtatggcttgtctccttcaatataattttgtcaaaaccntcttgactgttttnacctattgttttctcacctatttttttaaaactaaattaactttggtgggatatggtttggatgtgtctccanccaaatctcatcttgaattgtagctcccctaattcccatgtgttgtgggaaggatccgttagagacaatttaatcatgggggcagttcccccataatgttgttcttgtggtagtgggtaagtctcatgagatctgatggctttagcaggggtttcccctttcacttggctcttattccctcttgcctgccaccacgtaagacgtgtctttcaccttccancatgattgtgaggcctccccagctacgtggaactatgagttcattaaaacttttttcctttataaattatccagtctcaggtatgtctttaattagcagcatgagaacagactaatacacagtgtaatcaattatttgtccagaacgtatcacatgcattcatttcatgtttgtaccaggagtttgtggtctcagcagagtcggtagttttcttcatgttggtcttcatgtaatacttgtatgttcctgtaggtcagaggttaagttggcttgcttggttttctgctctggtttcacaatgttgaaatcaaggtgtcatcagggttgcagtgttttctatctcttaacaatccttaattcttaggtcctntatagtttcatttgtnctcctng

SEQ ID NO: 52242 - DNA, 376 bp, Homo sapiens
cacaaatggggaaataggattgcagatgaataggactaaactgctatgttctaccatccttctgacaataatgaaagggaaagatgaagttctaaaagtgaattcattcactcattctgttcacaaatgcctatagtgcttactttgtgccaggcatgattctaaatattggaaatgaaacagggaaaaagacagccaagaacactgccctcaggggagctacattaaaatgattggaattataatgcactgcaggggagtctcaacaccctggagttgaagagtcttcctgtgtcccctgcctttggtaagagtcctcaagacacactccccatccccaccccaccactgccagggagccaccctgacaggcatg

SEQ ID NO: 52243 - DNA, 811 bp, Homo sapiens
agtcaaattgaaggttcaaagtccatcactgctgtttcttaggctcaatggttcaccacctcctcctcttcccaagatggcatctccaggaagaaacaatttagacgacttcctaaggaaggcaggggctgctggtctcctggggtcctgcttgtatccactgttgaaatccttggtttcacttgtgatctgtggtctgttttcttgacatagttgaggccaggcaataataacacctccactaccacctccaaaactctcagctcagctttcctggagtcatggatcctctgtctgagacatgcactctgcctggccctggcgcaggcagcctaccttgcaggctctgcatggcgttaccttgcctctcacccagggtgcccatggcaatgctcctgacttgcatctctcacctactttccatgtcccccactggggacgtacaggaacttctgaaactgtcccctcaggttcaaaccatggggaaccagcagggtggggaccctcagaccctctgtctcaccaccttgtgtcacatggtcatctctaccacccctcaacccccacagctgctaacttctggcctgaaacaagtgttctcctcccataaggtcccaaatgggacacaagttttattgctctgggattcttccaaacttaactgactctgaccctgacctgttcaggattttgagaggagccaaaacacgtgcctggcccctgtaggcatttgacattgcaactcctgtgccaacacatgcattcactaacaaagctattaaaaaaataaaacagacttttgagatcaaag

SEQ ID NO: 52244 - DNA, 442 bp, Homo sapiens
agatctgaggtactacattgtgcctgcagctaacaatagtgtattgttcacttaaaaaaaaactgttaagagggtagatgtcatgttaagtatccttaccacaataaaataagaagttttaaaagaactgggtacattttgcacttagttaaaattgcactgaatttgaataatataatgatatgtatggcaactaattaattttttccctctgaaacagagaagccgttttccttcatccccgggagaaataaacacacacccttaaacaggggaagtagagcaagaaaaatatgtttctaaagacaatgtttttgcagcttagcataaactaagtaaagcatcaacacttcgagaattttctctggtgtttaaaatctgatggacatgaaaattgagatttgaaccttttataaaggaactttattggtaatgttcaaaa

SEQ ID NO: 52245 - DNA, 518 bp, Homo sapiens
aggaattgttattatcctgtgatattgtgaaatacatagttgatcttctccccgtttcctgacatacaacttctaaaatccttagaatctccaaagtgatgtctttttatatgctgatgagttgactgatgcctggcagcccctgggtagcttcaggatggggctggtcactggaaagaccacagcaggattagaaggatggcaatttcagctccaccccatcaacatctggggaggagggcaactgaaggtgaagtggatcaccaatggctgatggattaatcaatcatgcctgtgttacaaagtctccataaaagctcccaaaggactgggttcagagagcttctggatacctgaacacatggatgttactggagggtgccacctggggtcggggggtgcaaaggggaaggagtatggaagctccgcaccctttccttcatacctcactatatgcatttctttttctatatcctttggaatatcatttgtaataaaccaggaaatgtgtttcgctg

SEQ ID NO: 52246 - DNA, 289 bp, Homo sapiens
cctgtcatttggtcaatccaagtgcatttggcctccgcacaagccactaattcaaatcagttccatcagaaccctacaattatatgtcttaaagtaaaataaaacttggatgctatgattgtaagttaaagattgctcaagtaatacaaacatttgatatagctgttgggcagagttacaacatttatctaacatgattcaaaatgttaccctgggagcatgatctctgcattttgtagaacacatacagttttgttaaattccttagtagcaactccagagttgtgtg

SEQ ID NO: 52247 - DNA, 372 bp, Homo sapiens
aagaaagttcagcatgactataaaagattaagtagagtttgttcatgcttttccatcttacttttctgattaaagcaggcattttaatatactgattggaaaaatctatttatgtatatatctccttccaatgcattactgatgaagttttcaaaattatctttttggggagaaaaaaaaagcttggaaagattgagtcttaatcagtcaaattagtagcacttcgtttttcctaaatgtacctttaaaatcgaagtcatctttggaatgttttaaagagttaacagtgttactaaagacaatacctgctttaaataagttatcttttccgatttcttccactttgttttattttttagcccataatttcac

SEQ ID NO: 52248 - DNA, 462 bp, Homo sapiens
gattgtaggtatgttagcttttttcatacagtgtattaaatttactgagtcagcttgctgaataagacagaagcccaagaattttaacagtgtgtagctttagttgtctaaaagttaggccttcgggcttcaaaagttagtggtcatcgaaaagcattaatctttgcagtttcaggtacaacacattggttttgattagggatggggatggggccctctttttgcagaatggggaaagtattgacaggaattgagagctattggtaggccagtgtataaggtatgtgaaaacagaattaagttattggtctgaagtgactgaagcatttaggctctatcaaggcctaaaatttggtaatatgagtttggtaatgcgaattgtggcagtggacaatatttagttaaaattatgtaattgcataagtactagcacagtatttttaataaaagttatttcttagc

SEQ ID NO: 52249 - DNA, 245 bp, Homo sapiens
atgactattcttatttacaacccacagtgccaatagatatttacgagtggtctttctaaaaacatttaatagatgttgtgagttcttttccttaccttttgatacagtgtctgatattatacaaataaccccattagaaatttgtctgacttagcaaacatacttgtttagaaagtgaatctttgagtaggtaaaaagattgttaataattcacaaaagcagcatgaattgatgccaccagtttg

SEQ ID NO: 52250 - DNA, 410 bp, Homo sapiens
ctggaagataaaacgattgattctcctattagtgacactgttgcagtataagcgggcttgtcagcaattactagcaagtaggagagaaaataatgtgaagaggtaagaagtctgggaatgaggatgagtaaacattgaaataactagctcaattatatttacagatatgcttcttgccatattgctcaataggataaagattattttgagtttccagtgtgagagatttttccatagttgaatttgcatgctatgccttcaattagattataaaaccctcagaggccgtttgaaaaactgctgcaccactaaatcgacttcttccaaagtgaaggctcctccatccaagctttcttatcattgggctcaaggttgaaagccagtaaaaagttttcttattgaagactgaa

SEQ ID NO: 52251 - DNA, 964 bp, Homo sapiens
ggtatttatagcaatgtgagaatggactaatacaagggggaagcacaagcaaagacagaaggaaaatacaacagggtgtctgtgagtgtgtgtgcacatttgtgtgtgcatgtggcggggtctacaaagagtcactgtgaaccagggagtggggagtgctgagaatggacagaaaagattcatgtgcccagttgagaaatataatttgaggagtcacagaagtattgttaagtgagagttgagatcgcatggccacgttcgtcgccaggtttctaactttggatggcatctttcaccacgcaggactcaatggggaggaagcaggggtatgggttgaggattctgatgagactgtcactactactctttcttgcttcattagtgttgtttgtgacacccagaagagctgaagggggcatctttgtggggaaggagtagaagggtagccctcagaaagggggttcctgggatagtcagaatgtgtttaccaggaagagaggcagaattaaggggctggcaacatagctgggaagttgactgcatgggttgtcatatctaaaagagatttcaaagatggaaacaggagcatgggcgaagttgagatctcagccccctcattttactgttcccctacttgtgaaattcattttagttcttcagggcccatctgaaatgccagcttctctctgaaggttttcctttagaccttggctggaagatatctctttctctttggaaactctataacttgtggtttgcaagtattttatggctttgtattcccccttatgtgtaagatccttgaagattgttttgcatatctttgtatctcctccaccacctgagactctctgctgtgtgtaggatctctgctgaagaaatcataatggaactgaatctgtactttcacaggaaaagtacatgctacaggatttaataaatatgaatcttacataaggaaata

SEQ ID NO: 52252 - DNA, 909 bp, Homo sapiens
ggtatttatagcaatgtgagaatggactaatacaagggggaagcacaagcaaagacagaaggaaaatacaacagggtgtctgtgagtgtgtgtgcacatttgtgtgtgcatgtggcggggtctacaaagagtcactgtgaaccagggagtggggagtgctgagaatggacagaaaagattcatgtgcccagttgagaaatataatttgaggagtcacagaagtattgttaagtgagagttgagatcgcatggccacgttcgtcgccaggtttctaactttggatggcatctttcaccacgcaggactcaatggggaggaagcaggggtatgggttgaggattctgatgagactgtcactactactctttcttgcttcattagtgttgtttgtgacacccagaagagctgaagggggcatctttgtggggaaggagtagaagggtagccctcagaaagggggttcctgggatagtcagaatgtgtttaccaggaagagaggcagaattaaggggctggcaacatagctgggaagttgactgcatgggttgtcatatcccctcattttactgttcccctacttgtgaaattcattttagttcttcagggcccatctgaaatgccagcttctctctgaaggttttcctttagaccttggctggaagatatctctttctctttggaaactctataacttgtggtttgcaagtattttatggctttgtattcccccttatgtgtaagatccttgaagattgttttgcatatctttgtatctcctccaccacctgagactctctgctgtgtgtaggatctctgctgaagaaatcataatggaactgaatctgtactttcacaggaaaagtacatgctacaggatttaataaatatgaatcttacataaggaaata

SEQ ID NO: 52253 - DNA, 324 bp, Homo sapiens
gtggaatgttacagaggtcaccctgctatcctgctgtccttcaggcctgatcccctcgtttcccagcaagctgggaggaaggcaccactaccaacgtcgccatttcattgatgaggaagctgaggcccggggatgcttgggaacttgcccaaggttacccagcaaagattcaagctgggcttcctgtgcaattgcaaaacttcactttactttttttcttgagacagaatatcttgctcttttgcccaggctggggtgcaatggtgcgatctcagctcactgcaacctccgcttcttgggttcaagcaattcacttgcctcagc

SEQ ID NO: 52254 - DNA, 276 bp, Homo sapiens
ggggttttgccatgttggccaggtgatctcgaacccctgacctcaagtgatctgcccaccttggcctcccatagtgctgggattacaggcatgagccaccacatcctccatgtctggccagtttcctggtagtaatattgtactgtgtaccttgtttatatgtatagctcttgtttctatgtaacataaaaacattatattgggagaaactggttgaagggtacatgggacctcttggtactattttttgcaatttcctatgaatataattatttc

SEQ ID NO: 52255 - DNA, 415 bp, Homo sapiens
attttacttgtgaagaaacagaagcctgaagaagggaaatttgacaagttcaagatcaaacaacagtttgaggcaggccatgttccctttccattccaccatgctgcctccttagagcaagaaaggtaactctcctccaaattgaagaagactggaattcaacacatagaaatccctaagtgatataacaggatgtagaaactgaggacccgatttccactcagagcgcttgtgagatcaagtatcataaagaatgtaaataattggctgggcgtggtagctcacacctgtaatcccagcacttgtggagactgaggcgggaggattacttgagtccaggagttcgaaaccagcctgggcaacataatgagattctgtctctacaaaaaaataaaaaattagtctggcatggtgg

SEQ ID NO: 52256 - DNA, 222 bp, Homo sapiens
atatatgttcgtgactgacatttttcccttagcataatgttttcaaagtttatccatgttgtggcatgtataagtactttgttcctttttactaatgaataatattagaaaaatattccagtagttgatggacatttgagttgtttctactttttggctattatgaataatactgctgtaaataatgttattatgaataaaattgtgtgcaagtttttgtat

SEQ ID NO: 52257 - DNA, 351 bp, Homo sapiens
atatatgttcgtgactgacatttttcccttagcataatgttttcaaagtttatccatgttgtggcatgtataagtactttgttcctttttactaatgaataatattagaaaaatattccagtagttgatggacatttgagttgtttctactttttggctattatgaataatactgctgtaaataatgttattatgaataaaattgtgtgcaagtttttgtataaacatatgtttttatttcttttgggtatatacctaggagtgaagttgctgggtcgtattgtaactcaaaagtaaccttttgaggaatcatggaatggttttccaaagtggttatatcattatagtccc

SEQ ID NO: 52258 - DNA, 291 bp, Homo sapiens
tttttaaaagatatcttttgtgtagaagtaacccaggaatgccagcatttgttttgatagtctcattccaatagtagttactttaaaatgaagaatgttcttaatttacaaaatattatgtatgtatttaagttatgaatattgcagatatgtaaatatgtgtatatgtgtgttgattttaatttgtatcttcacagattttattatcagttatgttttgaatttttacctttggagaaaacatactacttaaatcttccagtgtagtgatagcaaattatctttatataa

SEQ ID NO: 52259 - DNA, 1615 bp, Homo sapiens
atcctgacttccgctttggaggcgaggacccgagcgagtgtagggggtgcggcgtctggtcagccaggggtgaattctcaggactggtcggcagtcaagccatcatgcctcgtggtcagaagagtaagctccgtgcccgtgagaaacgccgcaaggcccgagatgagacccggggtctcaatgttcctcaggtcactgaagcagaggaagaagaggccccctgctgttcctcttctgtttctgggggtgctgcttcaagctctcctgctgctggcattccccagaagcctcagagagccccaaccactgccgctgctgcagctgcgggtgtttcatccacaaaatctaaaaaaggtgccaagagccaccaaggtgagaaaaatgcaagttcctcccaggcctcaacatctactaagagcccaagcgaagatcctctaaccaggaagtcagggtcgttggtgcagttcctgttgtacaagtataaaataaaaaagtccgttacaaagggagaaatgctgaaaattgttggcaaaaggttcagggagcacttccctgagatcctcaagaaagcctctgagggcctcagtgttgtctttggccttgagctgaataaagtcaaccccaacggccacacttacaccttcatcgacaaggtagacctcactgatgaggaatccctgctcagttcctgggactttcccaggagaaagcttctgatgcctctcctgggtgtgatcttcttaaatggcaactcagctactgaggaagagatctgggaattcctgaatatgttgggagtctatgatggagaggagcactcagtctttggggaaccctggaagctcatcaccaaagatctggtgcaggaaaaatatctggagtacaagcaggtgcccagcagtgatcccccacgctttcaattcctgtggggtccgagagcctatgctgaaaccagcaagatgaaagtcctggagtttttggccaaggtaaatggtaccaccccctgtgccttcccaacccattacgaagaagctttgaaagatgaagagaaagccggagtctgagccagagttgtagccaggccttgcactactgccatagccaatcaatctcccaaagccaagtttacctgctgttctcacccccaatgaggtcttaggcagattctttactttgtaattcaaaaggcctgttaacctttgttcttgttatgcatgaataacttgttgacttttttttttttctctttttcaactagtgtttcaacaggtttatttagattcagaatgtaaatttacaaatgatatagatcaccctgttattgctgtttttcagggacagtagaaagtgttttgttttttgagtgaaacaacttattaataaaaatccttaaatcacttttgtaatccaggacaagaaaatgtggcattagaatagaaatatctttggaaatgtgaaagaccccatagtgaaatatttgggatcagaagccagaggggtaaaagtggtcaattcttggtttacttcatttaatctttcttttcataaagatacatacctggatttgtttatgttattcaagaatgtgtgagaaattaaaccatagttagttaaa

SEQ ID NO: 52260 - DNA, 1296 bp, Homo sapiens
atcctgacttccgctttggaggcgaggacccgagcgagtgtagggggtgcggcgtctggtcagccaggggtgaattctcaggactggtcggcagtcaagccatcatgcctcgtggtcagaagagtaagctccgtgcccgtgagaaacgccgcaaggcccgagatgagacccggggtctcaatgttcctcaggtcactgaagcagaggaagaagaggccccctgctgttcctcttctgtttctgggggtgctgcttcaagctctcctgctgctggcattccccagaagcctcagagagccccaaccactgccgctgctgcagctgcgggtgtttcatccacaaaatctaaaaaaggtgccaagagccaccaaggtgagaaaaatgcaagttcctcccaggcctcaacatctactaagagcccaagcgaagatcctctaaccaggaagtcagggtcgttggtgcagttcctgttgtacaagtataaaataaaaaagtccgttacaaagggagaaatgctgaaaattgttggcaaaaggttcagggagcacttccctgagatcctcaagaaagcctctgagggcctcagtgttgtctttggccttgagctgaataaagtcaaccccaacggccacacttacaccttcatcgacaaggtagacctcactgatgaggaatccctgctcagttcctgggactttcccaggagaaagcttctgatgcctctcctgggtgtgatcttcttaaatggcaactcagctactgaggaagagatctgggaattcctgaatatgttgggagtctatgatggagaggagcactcagtctttggggaaccctggaagctcatcaccaaagatctggtgcaggaaaaatatctggagtacaagcaggtgcccagcagtgatcccccacgctttcaattcctgtggggtccgagagcctatgctgaaaccagcaagatgaaagtcctggagtttttggccaaggtaaatggtaccaccccctgtgccttcccaacccattacgaagaagctttgaaagatgaagagaaagccggagtctgagccagagttgtagccaggccttgcactactgccatagccaatcaatctcccaaagccaagtttacctgctgttctcacccccatagtgaaatatttgggatcagaagccagaggggtaaaagtggtcaattcttggtttacttcatttaatctttcttttcataaagatacatacctggatttgtttatgttattcaagaatgtgtgagaaattaaaccatagttagttaaa

SEQ ID NO: 52261 - DNA, 575 bp, Homo sapiens
aagaattccactgcttgaacacatcagcaacaactgcttgataaccaccatgcttgatgattttcaggctctcttctagctctgggatgctgtgactgtagcagaatccagtgtggttgtttattgtgttctggatccccctctccccctggcaaccactccagtttagctgtcttcaacctctcccaaagagacagacctccctgtcactgagcggagatagccctgatctgagcctcctatggctgttccttgtcagtttggttcttgctctgaaaaacgaatattatcatgccagtctcccaggatgctgaggtgttgtttcgagattctacagaggggtaggtgggtgggccctggccaagctgagagagacactggggacctgtcaagaatatcacatagttatcagccttgtgaagaggctgtcagaaatatacatggtggggtgggtgcggtggctcacgcctgtaatcccagcactttgggagactgaggccggcagatcacctgaggtcaggagttcgagaccggcctagctaacatggtgaaaccctgtctctgctaaaatacaa

SEQ ID NO: 52262 - DNA, 411 bp, Homo sapiens
gagacggagtcttgctctgtcacccaggttggagtgtaatgtttcaatctcggttcactgcaacctccacctcccgggttcaagtgattctcctgcttcagcctcccgggtagctgggattacaggcacccaccactatgcctggctaatttttgtatttttgttggagatggggtttcaccatgttggccaggctggtttcgaactcctgacctcaggtgatccacccacctcggcctcccaaagtgctgggattacaggcgtgagccactgtgcccggcctgctatatgcattttcatagtcacctttttattctataatttgggttcataataatatttaaaccaaatttattactcatgacatataacagtacactagtgtgaccttgaaagtccaaaaaaacttag

SEQ ID NO: 52263 - DNA, 1193 bp, Homo sapiens
gccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgc

SEQ ID NO: 52264 - DNA, 1325 bp, Homo sapiens
gccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcagcaggtgagccactcccagttgatcccttttccctggagtcagtcatgtgtcccggaagtgcttccagcagctgctgaagacctctgccctatgaggtcactaggagttctttcattaagtgacctgaggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgc

SEQ ID NO: 52265 - DNA, 369 bp, Homo sapiens
tgccatcttttaataaatattttcttagagaagctaatttgacaggctttctgtgtcttagatacctgatggggaacttcccttttgactgtccctatatcaattctacatctttcaaggcccacccaaattcttcctttttcttgaatcacatgaaaagataaggacatgatgccaactcataccaatcattcctgaatacatcacacaaaatctgcacttcataatttaagctgagatgggagcaactttcacttgtgaaacaatgcctttgatagactataactcactagactgaaaccctccttagggcagaggtaaagtgttgtatttcttcaatagtttctataattggagcactccagtagg

SEQ ID NO: 52266 - DNA, 1222 bp, Homo sapiens
gtaaaatccacttgagggagtgagggttaagacataagtgtgagtttgatgaatgaaagaactactctgtgtgtgggttcttggcaagctgccatgtctttggggatcatagaaattattgatgacacagaacactcatatgcccttagcctgtacagctgattcaacatggaacagaaacactgtctagagaaaagattttacgttgtattaaagcagcatgggctttgggtatttttatgctttaaagattacttgcaataattattttaaatgatttctgcattatgagaatttcctgaaaagcagcattatccaataactgtttaccccgtacctggtatgataaagaattattttcagaaacatttccacagtgtttttaaaaggaaggaacatcccttaggagatattgttttaattgttgctaaaatctacttgctgtatttttctcagttgtttgataaaattgtatcataaagaattaaatgagttttttaagaattagttaaactatattgtctggtcatatttattgttctgttctcttttatttcaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaacaaaaaaaaaaaacaaaaagtgcgaaaggagcaggagaagcagagtagagataaaaagagaagagaagacgaagaggataaagagacaaagaagaccgtcgggagagggaaggaaggagagatgagcctagcgcgaggcggagcgaggggcgcagcgggacggcgccatgaaaaggaggtcggtagggataagagcggcggcgcccgagttggaggggggggagtcgaagaggcagcggagggggcagcgggcgatgtaaaacacgagggagagagcgcg

SEQ ID NO: 52267 - DNA, 3259 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52268 - DNA, 3808 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactcaacatgtaacattcaaaattgtgatcttcataaagacattgttaccattcgtcttgcaaatttaagacaactgaatgaaaagccaattttttgaaagaatgtggcatataattagatatacaactgaaacaggatatacaactgcatacaatttgtttttaatgatattttaaaatagcctgttagcaggaaaatagtccctatttatctgctaatggtcaaaaagagttaggatataaatcgtaccaaaatgtttccaatcactcagaaaaactgattcatgtctggctttgcaacaccttaaacatttattctgtcatagatagtaaagccccatctcagtttatttagtcctgaggttggcagcatggggtttgactatatgagctaaaagatacacaaagagataacgctgtttcataataaacaggaattgactatacaaataggtaaaccagcatatctacctgtatttctcagagtttagatgtgtgctttatgtttacattaaaataaagcctaacgccacagtagatcatctcatactgca

SEQ ID NO: 52269 - DNA, 3277 bp, Homo sapiens
gccagcacctgcaggcggagaagaagaagatgcagcagaacatccaggagcttgaggagcagctggaggaggaggagagcgcccggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52270 - DNA, 2160 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtata

SEQ ID NO: 52271 - DNA, 2043 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgtt

SEQ ID NO: 52272 - DNA, 2171 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagccatttaggtaacagcctttaggtacagccatttaga

SEQ ID NO: 52273 - DNA, 2563 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgcatcaaggttgaaaaactgtcccggacgcgtggggaaaaagaactattacaatcaaaaacaggtttatctagtgtcgaaaaccagttcttctcaaggtataataagaaatacgactctagtcaagatccatagcatctgaagttgtagccaggcctgtttcattgtctaatgataagactgatggaaaagtcagagcccgttgaccagcgaagacatactgcaggaaaagcaattgttgatagtagatcagctcagcccaagagaaacctcggaagagagaaacagctcgtctgagtgagtggaaagctggctgaaggaagagtgctatgaaggcccctaagttcagtagttactcagcatgaagcctgcaggacactgtgagaaaccagttgggtctttttggattaccatggcacgaagaagatgaaccaacagattatttactggcaacaagtaaagcaacaacatagctcggaatgtcctgaacttgattaagtggagggatgtctccatagaagatatcctggtcacacctgtaatgaccctgatttcacaatcattccggtttccaaaaccttggtcaggcctgggcaattgtctggcaccttttttggaccctttccaaag

SEQ ID NO: 52274 - DNA, 1872 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggatactcattcttcttgtagtgtagtgtagaaagtgaaccggggtcctcta

SEQ ID NO: 52275 - DNA, 3186 bp, Homo sapiens
tggctagtcgaggctgggtggtaatcggccgaggctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52276 - DNA, 3223 bp, Homo sapiens
gccagcacctgcaggcggagaagaagaagatgcagcagaacatccaggagcttgaggagcagctggaggaggaggagagcgcccggctgttattgttcggctgggctcggtcgggcgctgtctccctcggctctgcgggtgtcagttcgtccggcttcctcacagcccctcactcccggcggctgacagcagcagcggcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52277 - DNA, 3016 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccggccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52278 - DNA, 1500 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaacaaaaaaaaaaaacaaaaagtgcgaaaggagcaggagaagcagagtagagataaaaagagaagagaagacgaagaggataaagagacaaagaagaccgtcgggagagggaaggaaggagagatgagcctagcgcgaggcggagcgaggggcgcagcgggacggcgccatgaaaaggaggtcggtagggataagagcggcggcgcccgagttggaggggggggagtcgaagaggcagcggagggggcagcgggcgatgtaaaacacgagggagagagcgcg

SEQ ID NO: 52279 - DNA, 3192 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52280 - DNA, 1141 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaatcaaacagtgatgcggcaggcctgtcccacttccgcacacactaccgtcttacgtcgtct

SEQ ID NO: 52281 - DNA, 1034 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcacccccattcccccactccagataaagcttcagttatatctcaaaaaaaa

SEQ ID NO: 52282 - DNA, 2941 bp, Homo sapiens
aggggtttatctttattttataaaaactggtagacacacacatagctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52283 - DNA, 3187 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52284 - DNA, 3192 bp, Homo sapiens
gccagcacctgcaggcggagaagaagaagatgcagcagaacatccaggagcttgaggagcagctggaggaggaggagagcgcccggctgttattgttcggctgggctcggtcgggcgctgtctccctcggctctgcgggtgtcagttcgtccggcttcctcacagcccctcactcccggcggctgacagcagcagcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52285 - DNA, 2907 bp, Homo sapiens
gttgtttgttttggttttatggaagagtggtttgttcgggttggttgatggttattgttggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52286 - DNA, 3175 bp, Homo sapiens
ttcaaatgtgaggctctgggttatttgcttcctttcaaatttgtcttcagagcttagttgctaggagtccattctgtcctttaataatgattcgtgtattgtgaagccattcagtaaattgggttgtcagggattgccaaaaagggtttagaggtcttgcgggctggggaggttgcaggagcgactacatgtgcactacatgtgcgtctcgttgacttgagcaatcttgagcaatagcggtgttttgtaactttttcctaagactggtgaagttaagttttcttgtctctctttatgcactccttccctacctgctcttattctgtatatgaataatatgaaaatgtagaggacattgtattaaaggaaactctccaaccttttttttcgttacaggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52287 - DNA, 3147 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52288 - DNA, 2771 bp, Homo sapiens
gtgttctaaatactaaccctcataataccctgaataatacagttagtatgttaaaaattaattaaaagaatggtcatcacaactttgaattccatggtacactttccacaaatgcttctgtttgtaccatgttgattagtaatgtgaccctttctttcccatgtttagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52289 - DNA, 1270 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgagtatatacatataaatattgttggtcaatattaatttagagttcacttttgattactattttatattttttattttataattcattattttataatttttttaattcctaaaatcaatcatgataatcagttaacaccattagtttacagtcatccaactgaaaaattggtatatgtggtatagtagttaaatatttatgttctagtagagcaacactttgtctatggaaatggattaaagtaagtggccctatccattcattgcaagcaatgcaaaataatataaatcccccaaagagaaaagaaaatccacttttatccacatgaccatatggtgtcatctgctttgggaataatgttctggtatataaatgcatgtactatgtactaatgcaagatgctctctctgttatctggcaggaaagagggaaata

SEQ ID NO: 52290 - DNA, 2981 bp, Homo sapiens
gtaaaatccacttgagggagtgagggttaagacataagtgtgagtttgatgaatgaaagaactactctgtgtgtgggttcttggcaagctgccatgtctttggggatcatagaaattattgatgacacagaacactcatatgcccttagcctgtacagctgattcaacatggaacagaaacactgtctagagaaaagattttacgttgtattaaagcagcatgggctttgggtatttttatgctttaaagattacttgcaataattattttaaatgatttctgcattatgagaatttcctgaaaagcagcattatccaataactgtttaccccgtacctggtatgataaagaattattttcagaaacatttccacagtgtttttaaaaggaaggaacatcccttaggagatattgttttaattgttgctaaaatctacttgctgtatttttctcagttgtttgataaaattgtatcataaagaattaaatgagttttttaagaattagttaaactatattgtctggtcatatttattgttctgttctcttttatttcaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52291 - DNA, 2277 bp, Homo sapiens
  misc_feature (6)..(6): n is a, c, g, or t
  misc_feature (8)..(8): n is a, c, g, or t
  misc_feature (21)..(21): n is a, c, g, or t
ttttgngntgcccaagacttngaatgggacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52292 - DNA, 2067 bp, Homo sapiens
aggtgcctgcaggacccccaggtagactaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52293 - DNA, 1833 bp, Homo sapiens
  misc_feature (48)..(48): n is a, c, g, or t
  misc_feature (57)..(58): n is a, c, g, or t
agagagagagagagagagagagagagagagagcaggagagagagaganagcaggagnnatagatagagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactca

SEQ ID NO: 52294 - DNA, 793 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaaggtaaaaaggctaatttagagcttacattgcattagtgatgaagactgtactgtttatttgactactttccttaacatttgttcaaatgtgagttaccagcctcttaaattataaaatttcggaaattctaaggtgtt

SEQ ID NO: 52295 - DNA, 388 bp, Homo sapiens
ctccggcggcgccggcagcggcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtttcgaggctgagcggcaccggggttggggcgcggaggaggagcagcagcgggaggaggagccgtgtgccctggcactgagcggccgc

SEQ ID NO: 52296 - DNA, 510 bp, Homo sapiens
ttcctgctactttcctgcttggtgtcttgcctttgaggtgatgttttcctcagacccctctgtgtccttcttgcttcctgggggacctttgtggaactagaaaatagctgtttactagcctggagcaaggagcctgagtggtgagccggctgcataaggaaggcacagcagctcatgcttccctaatgcttcactaaacatgcaagacacaaaaggacccagagggctccagcaagggtctggggaccgaacgtctaagcttggaaactggctggacttgtatgggtaaaaccaagagtttttgtcttagctctcccgcctcacagctttgaactgggggtggctcttggtctgcatttcacatgcacggcacctggagaagtgctgctagccctggcacctctgtggggttctggccctggcggagactttgccggccacggcttctccaataggttgctggtggcatctccagcaattggtggtcattgagttggagaagaagaaaag

SEQ ID NO: 52297 - DNA, 428 bp, Homo sapiens
gtttctgggtgacatggccatggattagtaagaaatacatactatatttaattaatgccctaatttatagataatagtggtattacatgaatttagtatattttcatgaggaaaccaatatgttcccttctattaagtagttcataaataatccagaattttcaaacactgtagatacactttatagatgataaggatatatcaaatgtgtagtttggtgttgattatggttatttatagtatctatgattttgcagtacccaaaaccagaagttgttataatatacatgttgttatacgctaatatacataaagtaatatacgtaagtatactttgtgtacataatagatctcaataattaaaaacttttttttttaaaactgacatttgttttatataatggcatttatagatgggctttgtgagt

SEQ ID NO: 52298 - DNA, 390 bp, Homo sapiens
tctgaccataaactgcatctgtctcatgagctggatccagtataggacagggacactgggccaccactggctctgtacaaccccagtgccccattctcatggtgtggatggagccccgttttctcctaaaacttgtcccactagttcaggggtccccagtccccaggccatagaccggtacttggttcatggcctgttaggaacccagccacacagcaggaggtgagcagcaggcgagaagcattccccactgagctccacctcctgtcagatcagtggaggcgttagatacttacaggagcatgaaccctaatgtgagctgcacatgtgagggatctaggttgcatgccccttgtgagaatctaatgcctgattatctgagttggaaca

SEQ ID NO: 52299 - DNA, 266 bp, Homo sapiens
agcatgggaaattccattaacagaaacaataatggtttgttggcaaacaagcaagggaggactgaagttttaatactacttggcaaacaagcagaggaggcctgaagttttaatactggttggggcagacagtaaagatcctgagagaagatagccacagttggctggccttgataaagttctacttattcctggttgggtagaagattatgtttatgcataaggctgtacatatgcatgagagatattggtgaaggccctaatga

SEQ ID NO: 52300 - DNA, 291 bp, Homo sapiens
cttccaaactcacagatcaaagtttctgacttagaaattagcaaaatctaggagtcctgcacaagctccaattctgtttgtttgtttgcttataacctcaaggctctggcatacacagtccacatggctgaaaatggaacaaaaagctcctgtgtattcaggctactgcccttttaaccatactgtaaaagcaagcatggaatgacagcacaggagaggacagaacaggatctgtgtttacttcatgctgaccagtatgaaattcatttattttatcaaaaggtgaatggt

SEQ ID NO: 52301 - DNA, 452 bp, Homo sapiens
aagagcgaagctgcacaatgagaggcccttagctccccgaaaggcaattataactccagcaggcacagcgagctggcagcaccgatccactgcacacctcatggcaagatgcctcgttgttccctcctggcctcacagctctcgtctgcttgtccctctgggcacattcacaatttatctgaaaagcacattgttcctgccccggggattaaggcctcagagtggcaggagtcggtgtgtgaaaatgaaggtgtgacaacgaaacacacatacacgccccataacaaacctcttccctttgaacagttaaaaaaggcttaagaaggcctgtcagccagtgtttgtgtgggtgaggctggagttttgtaaagggaggaaggagttggaccacacttgcctgcacggtggccctgggacacacgtcccttggtgggctcctcagagctcctcga

SEQ ID NO: 52302 - DNA, 333 bp, Homo sapiens
cacctttgggaggtagggatcatagttccacttcattgatgaggaaaactgtagtgcagagatggcaaacactgtccaagaacatggtggtggatgggacccaaaccccaacttttgctcccatgttctctgtccactggctatggctcttgcccctgtgtacagatacaggctctggacaagttcaccaaatcccttaggcttcagccccctcatctgcagaatagtggcttggattccaccatcttcaaggtccctgccagcttttctttatttgaatttggatttattaagcagaaaaaaaagtaatgggagtttgtgggtaccaatgga

SEQ ID NO: 52303 - DNA, 239 bp, Homo sapiens
gcaatcttttgagtgacttactttgagtctttgtcacctttcctctgattttttcacatggtttaactcagtgtacccaagagtactaggtgcactcaattctgctattaactctataagcaagttcttaagaaagttaatgttaaaaaataatcttaaaattgtcttgataggaaaaatgtatttgaaattaaaaaaaattcttatgttgacttcttggttttgaaacaatgaatata

SEQ ID NO: 52304 - DNA, 169 bp, Homo sapiens
attaggtaaccattttttggtgactgaaaccctattgatctattctctaaatgtctgccatttgaagaatcccagggcaaactactatgcttttattggctttgtaaattgggacttccataagttgggcttccaaccacattagcattgttagtatggtggcattttg

SEQ ID NO: 52305 - DNA, 323 bp, Homo sapiens
taggcatatggcttcccaaaatactagtttaattcgtcggttaaatgcatggatcatagtagacaagttatttctagtctataaccagttaataattataaaatcattgccatttctaaagtgaaatagcagctaatgtttaataagcgttcagtatgttgtaggcactgtgctacatgttttcctgtgttctctcactgagttctctatagtctatgaaggagggactactattatgtctgttttgtttaaagcggaactgacatggtgaaaaagtttgtggagaaaagtcaaatcacttgctcaagataccaagtgaataa

SEQ ID NO: 52306 - DNA, 641 bp, Homo sapiens
ctacccactagatgccatgagcacctcccactccaagtcgtgacaaccaaacatgtctccagtcattgccaaatgtcccctgggggagcaaaatgtcccctggacttctgttgaatcactgtttggaagtgtttacttgagtggttttcaggccagggcctcatactctgaatttttgttgtaaatggtctgggggtgctgggggtggagagcagagcactggtatttttaggagatccccctgtcattctaaagcatatccagggttaagcaccattaatcagatgatcttctgtctgatctgctggccccctttcatctatgtgcagtatttttctctatgctttttaaaataatgaaagtttcttgaactccatcttgacttgaaatatagcctgccacacagttagcaaatatagcaagaataacaagtgttctaaatggatttttaatttattatggcaatagtacattccaaagggtggcattttttaaaatgagatttttcttttgggcctaagattacagtcacatggttccaaattcagagggttcaaaaggacacagaaaagcctgcttcccacttgtgcccactggcctccccttttttcgcataaatggcagtttatagctttgtctgt

SEQ ID NO: 52307 - DNA, 470 bp, Homo sapiens
  misc_feature (433)..(433): n is a, c, g, or t
  misc_feature (452)..(452): n is a, c, g, or t
aggtgtgaaccgttttccaaaaatggttgtactgttctacagtcccccaccaatgcttgagttccggggcctccatgctgtgccagcactgcttggtgttgtcggtctctccaatttttgccattctaacttgcctgtggtggcgtctcactgcctttaaaatgtggatttccccatgactagtggggttgaccatcttttcatgtgtgtcggcctttggatgccttctcatgaagtttatgttcaatcttttgtccattttaaatattgggtttggcctgttgggctgctcttgtaagagttccttatatcatctggaaacaagtctttgtgagatatatatatatatgtgtgtgtgtgtgtgtgtgtgtgtgtgtgtatatacatatatatatttatttgtttgttttttgagacaaagtcttgctccaanccagggaaaagaagcagantccagtctcaaaaaaagg

SEQ ID NO: 52308 - DNA, 276 bp, Homo sapiens
gattgttacctttattgatgattttccctttgtgcttcctggtgtctggcaccaagaccacacccctacttctccaatggccctttccctcagtaagcttagcttattgctcacctcccaccttctccctgaaccccagcagaaagacatggacctgtcagatgctcccgatatttaagtgtctatgccaaaatctcatgtggaccttgtttgttcaaatgagttactattgagagagacagcaaagtcatcttctttagggaacctgaaaattgt

SEQ ID NO: 52309 - DNA, 332 bp, Homo sapiens
aggttctataatattggatgtcagttggttgcagttctcacctatttgaaaaaaaaattgaaactacttgtcgctaaaccatggtaactcaaaaacattaaaggcaaatatctactaaggcactatatttcatttcataatttatttctccatcccccaaaaaaggcatcacctagttatttataggacactatcactattgcaacataacagaaaaatcttaacatcattgataactgtagcattttagtgtgtaaaatctatattagattttaggtgtcaaatctatactagattctaatagtgcactctacattcaacctctgatttaa

SEQ ID NO: 52310 - DNA, 257 bp, Homo sapiens
agagagcagaaatcggttcttgggaggacaaaaataaataaataaacaaatggtctgtggccctcaccaaagctcaaccttatctgaaaaatgtatattctttagtactggattcctcccattagggagaacttaattacctgggctaatttaataaaaattaaatctgttattaattacattttatttaaatgtaatttttctcctgagggggtaataatgaaaaaatgttgagaaacactgttctagataaacct

SEQ ID NO: 52311 - DNA, 379 bp, Homo sapiens
agaccaaatcgtaaaacctccaaaggtttcaaggtcttcttcaaaactatgaagtcagctgacatcaatacctttcccattccctacccaaattaaccacgtttatctttcaatccagaattgagaatccagtcttctaatagccctataaaaaaattttttttatagcccgggacattaaagagctattttgtgtcctggtgatgtagaatgcaattggcaaagaacaggagggacatgtctagtgtctcccttcagactcattagtatgctccacaaagtaaatgagactgagcaccaccgtgtccccataacattaccaaactccttgtacttctcacactctgtgtgatttaacccacaatctcagccacatccc

SEQ ID NO: 52312 - DNA, 855 bp, Homo sapiens
gcaaagtaagaagacaccagttaaggagataatagagaaagagtttgaaagaattttagataagcaacttgattagcggtccagtacaacatgtgcacaggtcctaaacaaatggaaagggtcaacctaactgaaggaaaaagaaaataactctccatgctgggacacacacagaactcttcattctgagtgccaaagcagctacaacttggctcaacaattgaactttacttccctactaattccatctgattgattctgccttcctcacctgagaagtcatctcttaagacttctctagtcttagtttccagatcaaagacctgtagatcctgttccagctgggagagcccatcaggcttggaaattggaaatcctgatcatagagaaggaaatgggtgtggcaatgtatccccagatgctacaccagccactttttcttttaactaatgattaagacagagagaaggtaaactctgagaagacgttaattaggaaggcctggagagtgaagagggcaaagatcttctacaaggagctcaaatttgggctctagaaagatgtgtgttaaggggcaagttgatggcttgggagcagaaggattcatttaaacattattcggacaacaggatgtgtgcatgggtttgtcttcacagaagttatccttatcactctccatctgttacctaaagatcaatctttggattagagctggtctacaagcatcaaaatggaggtcatcaaaatataattctgctggactggagaaaggtgaaactcaagcatctgctacatggttagctaacctgtagcaaaagaatcagtgaaaactgaataaatattctaagaaccaaa

SEQ ID NO: 52313 - DNA, 372 bp, Homo sapiens
ttttttttcctttggagagagtctcattttgtcgcccagcccgggaggtcgaggctgcagtgaaccatgatcatgccactgtacttcagcttgggcaaccaggtgagatcctatcttaaaacaaaaacaaaaacaaaaacaaaacaaaaaagcaccacaagtgatgctgatgggcagcttggattaagcaccactgaattaaaataataaaggttaggggtaagaatgctgcatgctttatagggatatctgaaagagcaacagttaggtttcatatagatggttactaaccatctctgcttttgaattttttttttaattttgcagttctgaatggttttcagattagtactttcagatgattttaagtat

SEQ ID NO: 52314 - DNA, 436 bp, Homo sapiens
  misc_feature (42)..(42): n is a, c, g, or t
tggctaatttttgtatttatgtagagatgggattttgtcatnttgcccaggctggacttgaactactgggctcaagcaatcctcctgctttgccctcccaaagtgctgggattacaggcgtgcgacccgcgcccggcccccccaattactcttaaaggtaacatcactattgtgaacctaagatcagctttttgagatgccttttcaggtgtaatggttaatactgagtgtcagcttgattggattgaaggctacaaagtattgatcctgggtgtgtctgtgagggtgttgcaaaagagattacctggggaaggcagatgcacagttaatctggtgggcacaatctaatcagataccagcgaatataaagcaggcagaaaaacataaaaaggacagactggcctagctcccagcctacatctttctcccatgctgg

SEQ ID NO: 52315 - DNA, 734 bp, Homo sapiens
tggctatgtttcttttcaggcatgtctactgtagtttgggcattaaaagttagcccacagaggtggcttacccccataatcccagcactttgggagactaaggtgggaggatcactttagctcaggagttctcacctggacaacatagtgagacccccatctgtacaaagaaataaaaaattagccaggagtggtggtttgtgcctgttgtcctggctactcgggaggctgaagtgggagaatcacttgagtccaggagtcaagactgcagtaagccataatcacaacactgcactccagtgtgggcaacagagcaagaccctgtgattaaaaaaaaaaaaaaaatagtaatgggttgtcgccacaggctaatcaagcctggatgtagcttgtatacctatgatgattgtcatgctaaattaaagagaaaattatcaaaataaaacaatttatacctctttattctaatttcagtggtaaaaagaaaattacatttagcaaattaaaacttcatagagatattatttcttacctatgagattgccaaaagttcaaaagtttgctaacatactccattggtcagattatagagaaatagatgctcttatacattgctaatcagaatacacaatggcatagcccctatccaaggcaatttggcaatacctaccaaaaatatacatttacacttggacccagccattttatttctaggaatcaatcccaaagatata

SEQ ID NO: 52316 - DNA, 153 bp, Homo sapiens
gcaaaagttgctcgatgactctaagctatgtagacacaggagtgatccttagaaagccaggctaataaatgagcagagatgtaaaaaactctacattccggggtaaacagatccacagttgaagcccagaaagttactagaaaagaagagaca

SEQ ID NO: 52317 - DNA, 488 bp, Homo sapiens
ggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaat

SEQ ID NO: 52318 - DNA, 333 bp, Homo sapiens
  misc_feature (305)..(305): n is a, c, g, or t
  misc_feature (315)..(315): n is a, c, g, or t
cttaggcccctgggttctaacccatggaaatgaatcatgaagcctgggcacttgtaataaactgctaccaagaactagactttgaaatatggagaaatactttttccatatgaatatccagtatccattgggcaaggaattaagaaagtgattccaagattttagagcaaaacaaatttgaggaagaatgtaaatatttcacatcagcggatgtgagactgtggttgcatttttagatccgagaattctgaggatggagtaattgcttgagcctgggaggtggaggttgcagtgggccgagattncggccactgnaccccagcctgggtgaca

SEQ ID NO: 52319 - DNA, 1804 bp, Homo sapiens
agagacgacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagagcgagagcggccgggtcctgcagatctcagcgggcgtcagatacgtgcagctgtcagcctactctgaggtcaactttttcaaagtggacagagacaaccaagagacactcatccagaccccatttgggttcgaatgcatcccttatcctgtgtccagccccgcagctggggtgccggggcccagagctgccaagggaggggcagaagccgacgtgcccctgcccaggggagacctggagctgcatttgggtgccctccatggccaggaggacacccctggtggcctgcttgccaggggacatgcgccccattgtcccggggcctgtcagcgagtggagcagggctgtgccgagttcacagatgtcctcctggggccgcccccgcctgggtaccaccccttcctgttcctggacagcctccacaagaaggcaggcggcagatccagaggcggcctgcaccccagggggacaccacccacggcacaggagcctcctggaggcagcaggcctgaggggagagccacggaggagcaggctgcggcagcacacctaggggagtacgtgctcatgatccgcgacgtgaccaccccgccgttcctggggcgcaggctgcccccggccttcaaacacctgcgggtcgtagcgaagagggctggccagccaccccatgtcctggaagaaggccctgaagcctcaagcagctggcaggccgcccacagctgcaccccagagccgccagcgcctcggtgaggccccgtgtccacaggaggccacctcggtgtgaatggaaggaaacgctgcctctgcttgcgtgactctgctccccgattctccagagccccgtggttgctggcttgaataaaatgctcagtggcggcta

SEQ ID NO: 52320 - DNA, 962 bp, Homo sapiens
tctgaatgtgtatacgtgtgggggggcacgcgtgcacgtgtgtcagagtgtccttcctttttaggaggaacagtcttccattctagtgaggggctactttctgcttccccactcatccgctgctggccatcgcagttgtttgtaccttgggctgttatgaatagtgctgctgtggacatgtgtatacaagtttttgtgtgaatgtgttttcatttctcatgggtatgcacctatgaatggaattgctggatcacatggtagatttatgtttgaactttttttttttttttttgagatggagtttcactcttgctgtccaggctggagtgcagtggtgcaatgtcggctctccgcaacctccgcctcccgcgttcaagtgattctgccttggcctcctgagtagctgggattacaggcatgtgccatcatgccccactaattttgtattttgagtagagatggggtttcgccatgttggtcaggctggtctcgaactcccgacctcaggtgatcagcccgccccagcctcccaaagtgctgggattacaggcgtgagccaccgcgcctggcctaaacttttaaagaaactgctaaactgtttttccaaaattgctgcagcattttacagtcccaccagtaatgcatgaaggttcagatttctctgcgtcttcccaacacttggaattgtgtctttttgtaatagctgccctgtgggtgtgaagtgatagttcctcgtgattttgattcgcatttccctaacgagtgatgacgatgagtggctctcgctgtgttgattggctgtttgtttatcttctttggagaaatgtctattcaaatattgtacccattttttaaaaattagactatcagtcaggcacagtggctcacacctaaaatcccagcacttcgggaggctgaggtgcgaggatcactagagcccaggagatctttcttcttggtgt

SEQ ID NO: 52321 - DNA, 610 bp, Homo sapiens
tagagacggggtctctccgtgttgctcaggctggctgcctgcacttcgattcctgtgcttgttctggctgaaggcgccggccgctcaagcgtgtttcggcagatatttttgagaacatttttttatttttaaatacatgtatagcatgagtgatggagccaaacacaagttttgaagccaagctcttggttctgagaaacaggcccaacactgcacagtgtcattcgcagtcaacccaaccactgtctgagttcacgtgacgatttctcctgccaggtcacgggaagttgttatttaaagatggcagttattacgaaggggcgtttgtggacggagagatcacgggagaaggccgccggcactgggcctggtcaggtgagctctagctgggatggcacattcactcctttctcataacccatcgggctcagttggtccgccgagtctagatgcagaaggcgtgacgtgtagacgggaagctttgtgccgtgagaggcctggcctaccgagaagccctggggacctgactgaggctctgtggtcaccgctgagagcaactcaggcttccggagacacttttctagaataaagatttatctgtcccaagtta

SEQ ID NO: 52322 - DNA, 1638 bp, Homo sapiens
agagacgacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagagcgagagcggccgggtcctgcagatctcagcgggcgtcagatacgtgcagctgtcagcctactctgaggtcaactttttcaaagtggacagagacaaccaagagacactcatccagaccccatttgggttcgaatgcatcccttatcctgtgtccagccccgcagctggggtgccggggcccagagctgccaagggaggggcagaagccgacgtgcccctgcccaggggagacctggagctgcatttgggtgccctccatggccaggaggacacccctggtggcctgcttgccaggggacatgcgccccattgtcccggggcctgtcagcgagtggagcagggctgtgccgagttcacagatgtcctcctggggccgcccccgcctgggtaccaccccttcctgttcctggacagcctccacaagaaggcaggcggcagatccagaggcggcctgcaccccagggggacaccacccacggcacaggagcctcctggaggcagcaggcctgaggggagagccacggaggagcaggctgcggcagcacacctaggggagtacgtgctcatgatccgcgacgtgaccaccccgtgtccacaggaggccacctcggtgtgaatggaaggaaacgctgcctctgcttgcgtgactctgctccccgattctccagagccccgtggttgctggcttgaataaaatgctcagtggcggcta

SEQ ID NO: 52323 - DNA, 947 bp, Homo sapiens
agagacgacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagctctgatccacccatctatagtaggagaaactcaaggagacatcggctgctacccaggcaccatgagctcagggttggtgaggcccctccgggagacctgttctccctctcgacagcaggtgtgttttctgcaaaccgtgtctcctgccttgcagccagtattccttaatgcaaagctctatgaagaacctttttttaaaaatgcattctagaaaaaaatgcattcctga

SEQ ID NO: 52324 - DNA, 826 bp, Homo sapiens
agagacgacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtgacataaacgtgagtaccggctgtattttgttt

SEQ ID NO: 52325 - DNA, 662 bp, Homo sapiens
agagacgacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggtgagctctagctgggatggcacattcactcctttctcataacccatcgggctcagttggtccgccgagtctagatgcagaaggcgtgacgtgtagacgggaagctttgtgccgtgagaggcctggcctaccgagaagccctggggacctgactgaggctctgtggtcaccgctgagagcaactcaggcttccggagacacttttctagaataaagatttatctgtcccaagtta

SEQ ID NO: 52326 - DNA, 901 bp, Homo sapiens
agagacgacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggtctggcgcccacaggagccgggtgctgtgagggtgggcgctttcaggacatggaatcctacgtccacttgggttcaggaacctctgagagggcctgcctgacttcagagggttggaaaggaggtagggggcccatgccctcttctccgcaccaccaggccatgtcctatgcccggcatacaccagtatgcccagcgggtcctgcggcgcttgatgcagctctgtcatccgctaccgcggaacagacgcccgtggcttaggggttaaaatggccactgctttattaactgctcctgatcctggggtcagtaggttggcctgggccctgcagggaggggcttctggtctggtctatgtggggtc

SEQ ID NO: 52327 - DNA, 4318 bp, Homo sapiens
  misc_feature (4)..(5): n is a, c, g, or t
ggcnngggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctccctcaaaggcgtttcccaaataaatcacactgtcaatca

SEQ ID NO: 52328 - DNA, 3178 bp, Homo sapiens
  misc_feature (4)..(5): n is a, c, g, or t
ggcnngggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatga

SEQ ID NO: 52329 - DNA, 1564 bp, Homo sapiens
  misc_feature (4)..(5): n is a, c, g, or t
ggcnngggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagc

SEQ ID NO: 52330 - DNA, 3736 bp, Homo sapiens
  misc_feature (4)..(5): n is a, c, g, or t
ggcnngggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccata

SEQ ID NO: 52331 - DNA, 3896 bp, Homo sapiens
cccggcgactcgcgggtgtgacgttgaagatgtcggccttctgagccgactgcggtggtcaagaggttgcatgctactgaaagtgtccttcagaagatattaaagagcagaaaaacaattgtttcatgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccata

SEQ ID NO: 52332 - DNA, 3733 bp, Homo sapiens
  misc_feature (4)..(5): n is a, c, g, or t
ggcnngggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaagcctgcgtgacaaaagtccgagcccgttggaaaggaaatgagtgaccgccgggcccaggccagacgagatggaacagccgggtcaaaaagggcacaaaattgtggcccaaacaaagaaccgggggggggcgcc

SEQ ID NO: 52333 - DNA, 627 bp, Homo sapiens
cccggcgactcgcgggtgtgacgttgaagatgtcggccttctgagccgactgcggtggtcaagaggttgcatgctactgaaagtgtccttcagaagatattaaagagcagaaaaacaattgtttcagtgaaacactctaccttgtttttggtttgattctactgatgtcagggtttagccggtagaaggagtagttcagtttgtcaattcaggagaaacttgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccata

SEQ ID NO: 52334 - DNA, 4984 bp, Homo sapiens
cccggcgactcgcgggtgtgacgttgaagatgtcggccttctgagccgactgcggtggtcaagagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctccctcaaaggcgtttcccaaataaatcacactgtcaatcacatggttctgaatccctgtctcaggctctgctttagagaacctgatctaagacatttggtgccacaagtggtcataggaagctgctgtgagagtggattgtggagttggtcactcgccaggagggagtgaagacccgcatcactgttaatagtcctggcatgtggtacctgtccagtcactaagtcattcacttgtggggaactgggatgagatacaggtggaaagcgatctattgacttgtagaggtttgggacaaacaggaaaataaagattatggaattgggtggctcttgctgaaagtcactgaatccttgaagagaagaaaatgacagggcaaataaccaccaatttaatgccaagtgtgtgtcagaggaccttcttggtagctttttaatttttttatagacagggtcttgctctgctgcccaggctagagtgcagtggtgcaatcacagctcactgcagccttgacctcccgggctcaagtggtctagccacctcagcctcctgaatagctgggactacaggcacatgccaccatgagtggctaatttttaaaaaacatactttagctgggcgcggtggctcatgcctataaacccagcactttgggaggctgaggcgggcagatcacgaggtcaagagatcgaaaccatcctggccaaccaacatggtgaaacccggtctctacttaaaatacaaaaattagctgggcatagtggcgcatgcctatagtcccagctactccagaggctgaggcaggagaatcgcttgaacccgggagg

SEQ ID NO: 52335 - DNA, 3624 bp, Homo sapiens
agcgaggatgcgggtgaagaaaacctaagggccccaaattcaacataagcgaggtttgcgggctgtcagcaagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccata

SEQ ID NO: 52336 - DNA, 3730 bp, Homo sapiens
  misc_feature (4)..(5): n is a, c, g, or t
ggcnngggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaaggttgacttactaacttgggccctttcaatagcttcacagttttaccaactcttcttttccaacaaaaaccgggggtttttagaatgttaaaggaattggggggatggcgattattaatacgtggcttt

SEQ ID NO: 52337 - DNA, 1596 bp, Homo sapiens
aaagactaggggattttcttctgtttgtttgtttgtttgtttgagatggagtttgctctgttgctcaggctggagtacagtggtgcgatctcggctcactgcaacctctgcctcccaggttcaagtcattctcctgcctcagcctctggagtagccaggactacgcactgcgccaccacacccagctaattttgtatttttggtgcagacagggtttccccatgttggccaggctggtcttgaactcctggcctcaagtgatccgcccacctcggcccaaagtgctggccaccgcgcccagtcagacttgttttttagtgaaataaattgttttcctttaggaccttattctttatgataacagattccaagaatatgcagtcttgtcaatggctgtttcatcctcagtttctttaaaaataaaatacaattagaacatttttagatatgctatatctatccaatctattttcctgtcacccagtaaggttttctatcatcagcacaggtctatgaaaggacagtaaagggtctcctgttacataccctagcactaatgtttgtaatagaatgttaagataagttgtttcatgtaatcggactacattcagtctttctctaccctctgtcctctatttacccacctatgcatgtggcctactaattatattgactgtacatgaccagcaagttgtaagttcttttaaaagcaggagctcaaccatatttgtattcacatttccttctgcttaaaacagggctcttgtttcttcagtaaatattcattcggtatccactaggtgtcagataatatacaaggtaggttctagggattccaagataaataaacacagatatgccaatatgagtctgacagttttggcggggagaggtggaaaatagatctgcaagccaaaaaagctacagtagaataatataaatattgtaatggcaataaaataccagaactattaattttacatttagtaatcattcagtatcaattaaatgggtaaaatggatatgttggcatgaatgacatataactgaaaaaacactaagaactgtatagaaactgaattagacatatgagtaatattagtaggaaggggagagaatatttgattccaggtaggctaccaagcaggatgttttttcagcacagccttggaataaaatctgtaacctttgaaaacaatcacatttttgttcttatgcaatctttgtttttaaatgtatttattgttttggctctagtccctgaatgttaaaattttagtgtcagtgttaattctcacttatcttctccagaccttactccctaattttctcattttcatttgccccaataagtgccaaccttaccttgaatagaatagtggatttatcagcttacaaggactaaaaagtcgtcatttccaaaaacatctgtccaataagtctgcctcagtgactacatttctagcattacaatgtcattcttagtacactgatttgatctttacaaattacataaatgtataaaattgtcgcatgtaccctaaattatatacatctattatgtatgtatcaataaaaaaataattttctgtgatt

SEQ ID NO: 52338 - DNA, 1214 bp, Homo sapiens
attctccagccaagcttggcgctaacagagtaggcgatttcacttcgtcgtcacctcacaaaaggcttccaaattcactgcggcagacaccgcaaaataaaaatgttaaatacatcctagctgggaggggattgaagcctccaggctcaatcaaaggtttgcaataataggattcatttaaaaaaaaaaaaaaaaaaaaggacagatgggtttagaaaatgttgcagtgaagactggaacgagatgagctcatagcaccagcctgtcttttgtggacccgcacaatgatccctgagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtggggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattacccctggatggggccaagggaatgttcttctaaggcaattctgccttcttagcatggttaagctctgtctg

SEQ ID NO: 52339 - DNA, 1072 bp, Homo sapiens
  misc_feature (1015)..(1015): n is a, c, g, or t
  misc_feature (1035)..(1035): n is a, c, g, or t
  misc_feature (1053)..(1053): n is a, c, g, or t
aaaaaaacggagtcacttgttgcacatagcatgaacattaatgttctactgaagtccttttgaatatgccttaagtccaagttgcaaaatacatggtcttagacttcggggacgacccagttctctctcagagctctgtgtgtacagagaacctggcagaggtggttgactgacctagttttgtcatgataagggtgttttccccaagattggtttcggcagaaggctgttgccagggcgtaaggcaaggggcagtggctttcgaaagctctgtggggaaagaggtatgatgtgataaacctctgagatggggatcaactcatatgaagtatacaagaaataccgtttttaaagatatggcgtttatcaagtcattgattcttatgaccaagttaatttccataactttgtagcttttacaaactgccttttcaaagccctgggtaacttctttcatttactgtttcaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaagttgnaccaaaaaaaaaaaaaaaanccgggggggggccggganccaatcgcccaaagggggg

SEQ ID NO: 52340 - DNA, 1059 bp, Homo sapiens
agtcaaaccagaactgattaacatagcctgtcaggctagaataatcatttctgactggactctgtgagtatgtaacatttgaagggatctgtcagttactggtgggacagatcactgatgggtcaagcttgcacgtcatcaaatacagcacatcctgactcacaaaattcccccgacatcatctgggagcacactgccaaggaactgccagggaaaaacagaaaacacatgcccagagcttattacagaaacttcgaagtgaattaccgagtctttgagatcgtaatgttaactaatgggttcagggagctacttctgggatcaatactttttaatgtccatacaattctatgagcatttgaatttgagcattttcagaggttttgttaatgaatgcactacatgtccctagacatcataatatatccttatatccaagaaaacagaacatatcactttttcaggtaatgatactgtctagaggccgtgacaggcatccccataagagtatctttctattgttgacttgaattttgataactgtgtatgaacataaggattttctttcttttctagccatggaatgtcttacccaatttcaggtttagtgaagatgtataaagcaaaggattacaatgtggatcacccactggtggtaaaatcataagaataaattatttaattaaatattataatcatcccaatttccataaatatatttgccaattctcgcctgcttagagtatggggtaaagtaacttaacatctagaatatgcagggaagaacagctttgtcatctgccggtcaccgcatttcgtttctccccagccccatggcctttctgtggtggctcacgtccccagcggtgttcactttcacggcccagatgtttccagagcgacacctggagatggcagaaatactgggtatgaaccattactcaaaattctgtgaccggccaggcacggtggctcccatctgtaatcccagcattttgggaggctaagttgggtgcatcacttgagcccaggagttcaagaccagcctgggcaacatgg

SEQ ID NO: 52341 - DNA, 650 bp, Homo sapiens
taaagacccactttgatgctaacttttacatttctagcccctggactttcaccttctgggaaaacaacagattatgcctttgaggtatattcactcaatccattatttcttttatgaatgactagaaaaaaataaaactagaatattttgctaatgaattattattttattttaaatctgttattaattcacattccataatctctatttgatcagaccatatttagcaaagtacctggttggtataatggaatataaaccttctgagatcatggctaatgtctagagtgctgtctttgtagagtcactaaaataggataaattcccaattctacaaattctccagtacatatatgttatgtgttaaatctttagttttttaattataacaatcccaaaagaggtcaaagtaaagtaacaattctggtgtatttttatcacactgtaattacataattacttataattatttgtttaagtccctgtctcctcctagtccaggaattttttttttttttttttttttggagacagcctcactctgtcacccagactggagtgcagtggtgtgatctcagctcactacaacctccgcctcctgagttcaagcgattctcctgcctcagccttctgagtagctgggattacag

SEQ ID NO: 52342 - DNA, 449 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaaggtattcttgtattgttgttattgtttctttactttaagcagaagctaactgttgatt

SEQ ID NO: 52343 - DNA, 2250 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52344 - DNA, 1901 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52345 - DNA, 2212 bp, Homo sapiens
ggtggagcgacccgaggagggaagaggactccaagcgccatggccgctgccgcccgagcccgggtcgcgtacttgctgaggcaactgcaacgcgcagccccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52346 - DNA, 2423 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggcaagtattcgagatgtctacggtctcctactgtaaatgttacatatctcacaagaccatgctaaatgacaacaatcacatcctctatttttaaaaatgtacaacgtgagtttgccagaagagtctattgcagttctagtggagttgaacctaacttataggttttcttgtaggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52347 - DNA, 2015 bp, Homo sapiens
ggtggagcgacccgaggagggaagaggactccaagcgccatggccgctgccgcccgagcccgggtcgcgtacttgctgaggcaactgcaacgcgcagccccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52348 - DNA, 2149 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgccccctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52349 - DNA, 2362 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaaaaacaaccttaagtattcattattggtatatagatcacttatagtatactagacagtggaatactatggtactgttaataaagatgaagtaaatctcttggaaaaaaatcca

SEQ ID NO: 52350 - DNA, 1346 bp, Homo sapiens
  misc_feature (13)..(13): n is a, c, g, or t
ctcgtgccgaatncggcacgagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52351 - DNA, 1626 bp, Homo sapiens
agtcaaaccagaactgattaacatagcctgtcaggctagaataatcatttctgactggactctgtgagtatgtaacatttgaagggatctgtcagttactggtgggacagatcactgatgggtcaagcttgcacgtcatcaaatacagcacatcctgactcacaaaattcccccgacatcatctgggagcacactgccaaggaactgccagggaaaaacagaaaacacatgcccagagcttattacagaaacttcgaagtgaattaccgagtctttgagatcgtaatgttaactaatgggttcagggagctacttctgggatcaatactttttaatgtccatacaattctatgagcatttgaatttgagcattttcagaggttttgttaatgaatgcactacatgtccctagacatcataatatatccttatatccaagaaaacagaacatatcactttttcaggtaatgatactgtctagaggccgtgacaggcatccccataagagtatctttctattgttgacttgaattttgataactgtgtatgaacataaggattttctttcttttctagccatggaatgtcttacccaatttcaggtttagtgaagatgtataaagcaaaggattacaatgtggatcacccactggtggtaaaatcataagaataaattatttaattaaatattataatcatcccaatttccataaatatatttgccaattctcgcctgcttagagtatggggtaaagtaacttaacatctagaatatgcagggaagaacagctttgtcatctgccggtcaccgcatttcgtttctccccagccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52352 - DNA, 754 bp, Homo sapiens
agtgctgggattacagatgtgagccaccaggcccggcctcttaattactaatcatgagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52353 - DNA, 1010 bp, Homo sapiens
aaaaaaacggagtcacttgttgcacatagcatgaacattaatgttctactgaagtccttttgaatatgccttaagtccaagttgcaaaatacatggtcttagacttcggggacgacccagttctctctcagagctctgtgtgtacagagaacctggcagaggtggttgactgacctagttttgtcatgataagggtgttttccccaagattggtttcggcagaaggctgttgccagggcgtaaggcaaggggcagtggctttcgaaagctctgtggggaaagaggtatgatgtgataaacctctgagatggggatcaactcatatgaagtatacaagaaataccgtttttaaagatatggcgtttatcaagtcattgattcttatgaccaagttaatttccataactttgtagcttttacaaactgccttttcaaagccctgggtaacttctttcatttactgtttcaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52354 - DNA, 938 bp, Homo sapiens
acaattagagattatggaaaagagccctctgtggccccctaagcctgtaggtctgtgtttttcagttttgctggccgagaaaaaagacccaagggagtaacatattattttctacaaggatgttctaaaactgctcaggcctgtgagtgaaatgatttgctgcactgcaagggagtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtggggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattacccctggatggggccaagggaatgttcttctaaggcaattctgccttcttagcatggttaagctctgtctg

SEQ ID NO: 52355 - DNA, 503 bp, Homo sapiens
acaattagagattatggaaaagagccctctgtggccccctaagcctgtaggtctgtgtttttcagttttgctggccgagaaaaaagacccaagggagtaacatattattttctacaaggatgttctaaaactgctcaggcctgtgagtgaaatgatttgctgcactgcaagggagggtctttcacagacgaaaggttcttaatttgatgaagttcagtttatcaccttttcctttttattcatcatgcatttgatgtcaagtcaaagaactctgcctacccataaatctctaaggttttctcccgagtgttttcctaaaaattttagtttcacatgtaagtctgtgatctactttgagttaatttttgtataaggtgtgagacttaggggggtgtgtgtgtatgcatgcacacatgagcacacctaggctatctctagtatcatgtgttcatttgttgaaaagatactctttcctccattaaattgtttttatgcctttgtca

SEQ ID NO: 52356 - DNA, 335 bp, Homo sapiens
cccagcaccagccgactttcttgccttgttctgcacctctcttcttgtctttgttcctcttcttcctaccacacaaggggcaagtatgtaggacttggcagcccctccgaaatgtcagagctaagtgagctcccccagccaacttgggccctcctggggaggcacacgatggccccgtgctgggcgttagggagaccccgtgggtgtgcatggtgtattcactgatcttgtgactgaactccacccagagcccgtttcttcctctctccctacagtcagcactttatgtcttctaggagccgacacccgcactgccaggatccaagatgcagggc

SEQ ID NO: 52357 - DNA, 447 bp, Homo sapiens
atttttaaatagactttatttttagagcagttttaggtatacagcaaaattgagctgaaggtacagaggtttcccatatacctcctgccccctcatacaagcacagcctccccccatcaacatcccccaccagagggatatgtttgtgatagtcaatgaacctacatagacacactgatcttatttaggccttagttccagctcccctagaagagtgacagttgccttgtggcctgaccctcctgcctggttttgctgcttggtacaaaggcctttagaaattccctggcgtggttgattggctaacaaggtaattgatgcagggccagtgggaggcagaacacagagtaccactgagtaatatctcctctgttcaacattgcagtggggatttctgaacccaaaacatcaaatctgtgtgggaatcgagcatatggaaaatctctg

SEQ ID NO: 52358 - DNA, 421 bp, Homo sapiens
gccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttg

SEQ ID NO: 52359 - DNA, 2370 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgataaatatatttgccaattctcgcctgcttagagtatggggtaaagtaacttaacatctagaatatgcagggaagaacagctttgtcatctgccggtcaccgcatttcgtttctccccagccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52360 - DNA, 2073 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52361 - DNA, 2327 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaaaaaaaaacaacaaacacaagacgaaaaaaaaacattagggggcacgcacctgggcccttgaaaaaggttaagaaaca

SEQ ID NO: 52362 - DNA, 2006 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52363 - DNA, 1572 bp, Homo sapiens
agtcaaaccagaactgattaacatagcctgtcaggctagaataatcatttctgactggactctgtgagtatgtaacatttgaagggatctgtcagttactggtgggacagatcactgatgggtcaagcttgcacgtcatcaaatacagcacatcctgactcacaaaattcccccgacatcatctgggagcacactgccaaggaactgccagggaaaaacagaaaacacatgcccagagcttattacagaaacttcgaagtgaattaccgagtctttgagatcgtaatgttaactaatgggttcagggagctacttctgggatcaatactttttaatgtccatacaattctatgagcatttgaatttgagcattttcagaggttttgttaatgaatgcactacatgtccctagacatcataatatatccttatatccaagaaaacagaacatatcactttttcaggtaatgatactgtctagaggccgtgacaggcatccccataagagtatctttctattgttgacttgaattttgataactgtgtatgaacataaggattttctttcttttctagccatggaatgtcttacccaatttcaggtttagtgaagatgtataaagcaaaggattacaatgtggatcacccactggtgataaatatatttgccaattctcgcctgcttagagtatggggtaaagtaacttaacatctagaatatgcagggaagaacagctttgtcatctgccggtcaccgcatttcgtttctccccagccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 52364 - DNA, 2472 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtggctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccagtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtggggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattacccctggatggggccaagggaatgttcttctaaggcaattctgccttcttagcatggttaagctctgtctg

SEQ ID NO: 52365 - DNA, 1718 bp, Homo sapiens
ggtggagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtggtgagcaagtctgagatttcatttctttactcaagctattgctttaaaaaatttttaatgtttataattcaggacaggtggtaaaatttaaatatgctatagaaggaagaaatttaactttatgttcctaaatgtattcttctttttctttttttccttttttcaccaccagctaaagtagaaacctaaatgtattcttaaattgaatgtggttcctaaatgtattcttttgtgttcctaaatgtattctttttctttttttcttttttccaccatcagctataaagtagaaacctaaatgtattcttaaattgaatgtggtttactgggttttttaataacat

SEQ ID NO: 52366 - DNA, 1654 bp, Homo sapiens
tcttcctactcccaggtaaaaatgctatagtatttgtgaatgttggcagcaaatgactgttccttacagagggttctctgtctccccaagtacccgaatgtggtgacctggtggcatcaggacagtgtggctcagcccaggaagccgggggagaagccgctgtcactgatgctgtggttgcctttggaggttgccctcacttccaggccagctgaccttgcctcccctgcttcagagaagtgcctgcaatcctgatggggaatgtaggcatctgcaccctcgaagtccagctctgacctcagtcccttctgacacgggacagtaagtgaagaagagtgggtggctcctgcctgtgctgtggaaggttttatttatcggttaccacttcattctccagcctgtagtgcccgactttgggttggaagctggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52367 - DNA, 1547 bp, Homo sapiens
tcttcctactcccaggtaaaaatgctatagtatttgtgaatgttggcagcaaatgactgttccttacagagggttctctgtctccccaagtacccgaatgtggtgacctggtggcatcaggacagtgtggctcagcccaggaagccgggggagaagccgctgtcactgatgctgtggttgcctttggaggttgccctcacttccaggccagctgaccttgcctcccctgcttcagagaagtgcctgcaatcctgatggggaatgtaggcatctgcaccctcgaagtccagctctgacctcagtcccttctgacacgggacagactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52368 - DNA, 993 bp, Homo sapiens
tcctgggctcaagtgatcctcctgcctcagcctcccaaactgctgggattacagttgtgagccaccatgcctggcctacatcttcatttttaagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52369 - DNA, 2479 bp, Homo sapiens
agcggggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctacctgacaccacagccacccttggtgatgagcctcggaaagtgctcctgcggctgtatggagcgattttgcagatgaggtcctgtaataaagagggatccgaacaagctcagaaagaaaatgaatttcaaggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52370 - DNA, 2780 bp, Homo sapiens
atcctggttatcataaatttgcaatttcattgaggaaagtgatataagtatttcttaatatattaatatatgaaataattttagagactttattaaatacacacagtcctctttatggtagaggaacagttcagcttgagctggtgaccggctgaactagaggggttactctgggaaagtggcgagtcggcagggcatgtctgcacagattttgtgccaggtttcctgcctgcacagcgctttcttctctgtccaagttctgtgctgaccacagctgtccacaggcatgtttacactccctgttcttgcaggttgacttgagagaaccacgtagctaaattggtgagagactcagcctgaccgcttgtctttagaaggcctgattggaagagtgcactctattgactttcctctaacaatgaaattgtgaaaggtacatggggcggctgtgagacgtgcagctatcgggtctcaccggcacatcccttttctcgtaaagcaatgaagcactttctaaggtgttggtactagtgctggaggctgctggtgcattagatgctgcccgtcacatcggtgggctgagaaaccttccttaaagacctgtgatgttttgtaaaccctgactgttctggtggttgcaaagttagtgtctgtttagtgttccccatctcaccagaagtgtttcctttttctcattcatagaggtcctgtaataaagagggatccgaacaagctcagaaagaaaatgaatttcaaggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52371 - DNA, 2511 bp, Homo sapiens
atcctggttatcataaatttgcaatttcattgaggaaagtgatataagtatttcttaatatattaatatatgaaataattttagagactttattaaatacacacagtcctctttatggtagaggaacagttcagcttgagctggtgaccggctgaactagaggggttactctgggaaagtggcgagtcggcagggcatgtctgcacagattttgtgccaggtttcctgcctgcacagcgctttcttctctgtccaagttctgtgctgaccacagctgtccacaggcatgtttacactccctgttcttgcaggttgacttgagagaaccacgtagctaaattggtgagagactcagcctgaccgcttgtctttagaaggcctgattggaagagtgcactctattgactttcctctaacaatgaaattgtgaaagaggtcctgtaataaagagggatccgaacaagctcagaaagaaaatgaatttcaaggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52372 - DNA, 1860 bp, Homo sapiens
gcggccgcctactactactaaattcgcagccgctcgcacgccattcagtaaggaaccaaaatggcttggtggcacaatgcaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52373 - DNA, 1894 bp, Homo sapiens
tgaggatccccaactctgccacccacagctcagttaatttttcaaaaaagttaattgtaatcttcctggcttctagaattgcagacttttagattaggagtgggtctttgagattgtgttgtcctcacacaacacaatcccagaaaaatagtggcagaaacagaacaccaagccgggttttctcccttgcctctcagtgtccttcttaaaagtcatgctgcaggagatcccgggaaataggcgatgggcatcctcttctccccttctgttctagactcgcctgtgtcccaggggtcttttgctctaaaaggtgtgttatgtcggtcagtcagtgcccacagcacccagggttagcaaggtgatgaatggtagcagtgctaagcatgtggatgagacgttcatcctgagaggcagggctgggctggcccatgcctataaaccaggcctcctgagaatgaaggtgtgtggggtgggctgggagcttgaggagcctgcacctgtagagcagcgaggcccccgagcagccctgctgcacaggccagtcctgtgcttttggtctcatgggtccgtgccctcagctcttgcctggggtggggattgggggacacatgggcagggttcaggccagcaggattccttgctgaggccttctctttgctgtctcctaggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52374 - DNA, 1393 bp, Homo sapiens
gccatggccaggccatctgtgtgtgttcacactcaccagtgcacctgtcactagcagatgaggcaagggtgtgggagtggtattcccattgttcttagttagtcccgtggaatatagacccatgatttgccaacactaactaggtttgcatccacacaagttaaaatgtccatctggcatgaaatcatttcatcagtcctgtaactgatactgtatgtctcttatatgtttcttgcttttatcattccaggtttgcccttgcatctcatttcctctggggactgtggtccattgtacaagccaagatttcatctattgaatttgggtacatggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52375 - DNA, 1840 bp, Homo sapiens
tgaggatccccaactctgccacccacagctcagttaatttttcaaaaaagttaattgtaatcttcctggcttctagaattgcagacttttagattaggagtgggtctttgagattgtgttgtcctcacacaacacaatcccagaaaaatagtggcagaaacagaacaccaagccgggttttctcccttgcctctcagtgtccttcttaaaagtcatgctgcaggagatcccgggaaataggcgatgggcatcctcttctccccttctgttctagactcgcctgtgtcccaggggtcttttgctctaaaaggtgtgttatgtcggtcagtcagtgcccacagcacccagggttagcaaggtgatgaatggtagcagtgctaagcatgtggatgagacgttcatcctgagaggcagggctgggctggcccatgcctataaaccaggcctcctgagaatgaaggtgtgtggggtgggctgggagcttgaggagcctgcacctgtagagcagcgaggcccccgagcagccctgctgcacaggccagtcctgtgcttttggtctcatgggtccgtgccctcagctcttgcctggggtggggattgggggacacatgggcagggttcaggccagcaggattccttgctgaggccttctctttgctgtctcctaggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52376 - DNA, 1755 bp, Homo sapiens
agcggggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctacctgacaccacagccacccttggtgatgagcctcggaaagtgctcctgcggctgtatggagcgattttgcagatgaggtcctgtaataaagagggatccgaacaagctcagaaagaaaatgaatttcaaggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaaaaaaccagtaatgatccacaccactgcattagtggaagctaccaacatggcggtttgaaaggtgcgtctacccttaaggatattgtctgcctcagtgatgagacgtaaaggatcagcta

SEQ ID NO: 52377 - DNA, 753 bp, Homo sapiens
tcttcctactcccaggtaaaaatgctatagtatttgtgaatgttggcagcaaatgactgttccttacagagggttctctgtctccccaagtacccgaatgtggtgacctggtggcatcaggacagtgtggctcagcccaggaagccgggggagaagccgctgtcactgatgctgtggttgcctttggaggttgccctcacttccaggccagctgaccttgcctcccctgcttcagagaagtgcctgcaatcctgatggggaatgtaggcatctgcaccctcgaagtccagctctgacctcagtcccttctgacacgggacagtaagtgaagaagagtgggtggctcctgcctgtgctgtggaaggttttatttatcggttaccacttcattctccagcctgtagtgcccgactttgggttggaagctggtaattattgaattagacctcctgtttttcataggcatgtttgtaaccaagctaggctgtcatttaattttaaccttaagaattgtcagccgggtacggtggctcacgcctgtaatcccagcacttcgggaggctgaggtgggcagatcacctgaggtcaggagttcgagaccatcctggccaacgtggggaaaccccatctctactaaaaataccaaaattagcatgcatggtggcgggcgcctgtaatcccagctactcaagaggctgaggcaggagaaccgcttgaacccaggaggtgacagaacaagattctgtctctaaa

SEQ ID NO: 52378 - DNA, 553 bp, Homo sapiens
aaatgccatagcaattgctgggtcactgtctgtagggacacagtgtccattcttaagggaatttggggcattgggtgagacttaaatgcactacaaaaacacttctcgttcctaagactgtgtgatctcactctttttagtttacttggtaaatgtcagtttttaactcccttttctttttcagagccggcgattagatactgaagaattaagtttgccagatatttctgcagaaatcgccgagaaaatggctacatttcatggtatgaaaatgccattcaataaggaaccaaaatggctttttggcacaatggaaaagtaagtggtcaaatcacttggtcctaacatagttttacagtggtggctcccagaagtaccataagtgagcatttgtttgccacagtagtcagaggtcttcctagttcactgaagtgcagggtgtcagctggtgatacttgtctcataagtaagtctttcttgtgtgtaaaagtcaattcctaaaccaggaaagaaggcttatgcaaaaatgctattgaacgggtgaagggacaga

SEQ ID NO: 52379 - DNA, 2623 bp, Homo sapiens
agcggggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgctgctgagctgcggtagcggcagcgcggccccggcgcccggcgtggggcagcagcgcgacgccgccagcgacctcgagtccaagcagctggcgccaacagccgcgctcgcgctgccccctccgccgccgctgccgctgccgctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctacctgacaccacagccacccttggtgatgagcctcggaaagtgctcctgcggctgtatggagcgattttgcagatgaggtcctgtaataaagagggatccgaacaagctcagaaagaaaatgaatttcaaggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52380 - DNA, 2425 bp, Homo sapiens
agcggggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctacctgacaccacagccacccttggtgatgagcctcggaaagtgctcctgcggctgtatggagcgattttgcagatgggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52381 - DNA, 2320 bp, Homo sapiens
agcagcacatccccgctccacagtcgccgcagctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctacctgacaccacagccacccttggtgatgagcctcggaaagtgctcctgcggctgtatggagcgattttgcagatgggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52382 - DNA, 2235 bp, Homo sapiens
agcggtggtcggtggcgccgggtctgggggccgcgggacagtcagaggcggccttagcaacatgctgttccagtgctccctacctgacaccacagccacccttggtgatgagcctcggaaagtgctcctgcggctgtatggagcgattttgcagatgaggtcctgtaataaagagggatccgaacaagctcagaaagaaaatgaatttcaaggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52383 - DNA, 1741 bp, Homo sapiens
ccacgcgtcgcggacgcgtgggtcgacccacgcgtccgcggacgcgtgggttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaacccaacctcaagctgtcacccttggatgtgtcctgaatctca

SEQ ID NO: 52384 - DNA, 410 bp, Homo sapiens
cttttccccaccccacatccaatccatccccaagtcctgtcagctccaactctaaagatatcctcaatccaatcacttttttccaactccattatagccacgacattctaccccccatgatctctctcctggactagtataattgggccagatggattccctgtttctctcttgcctctcaccaacctattcttcaaacaggatccagtattactcaatataaatcagaccatgccattccctatcccaaaattttccaatggtcttccatcaggtttaaagcaaaatctgaacttctcaccatgagctaaaatgtcctgcacaatctggtccctgctaccctctccagcctcctctcctcctactccccccttactcatcctgcaccaaccctgctggcatccttggtc

SEQ ID NO: 52385 - DNA, 352 bp, Homo sapiens
cagcctggctggggggagccagcttgtgatgccaacaaatttgtgcctctattgttgactgggactgattctaatatctatgactatgcctgctttcagttgtcattctcagtttctcccacctgagtcacttgtctatcccaatccagttttccatcccttgggactgcctggcagtaaaaggattattctggtacatttctttcttctgagtctgtttcctgcttcactctctgatcttccagtatactcctgggagttcagtttcctttaaactttgttgagcacattgcattttctgtaccagaaatcattcattcgtttgtcactttctgagaacagactcggtgcc

SEQ ID NO: 52386 - DNA, 449 bp, Homo sapiens
tctatgctcttgaggttacttatgtctattgtatgtgtatagaagaaatactatgtatcagtgggctgtggtacatctctttccaattctacattcaatgacatcacattggtagattgaaatttgacttggtagcagtattgcagtgtggaaataagcaaacgctacaaatctgggcttgatttattgttttgtttattgtccagacgtgagaaagtgatggagaaaatgttaatgatgcagcttaaacttgagatgttttgactgtagctgtgacattgtgaatagcacaaataattgagcaaataatcttccagtatttgaaaactattatcagattcagcaataaagtcattcatatggttgataaatgagtgaagttctcgcatacattctgttgttttactttcgtcttacttattaaagcaaataaaaatatcaaacaatgt

SEQ ID NO: 52387 - DNA, 399 bp, Homo sapiens
agagcaagagatgtgttttatgcttcaatttcttgcacacagcaataagcacagggtttccacatagccagtactcaataaagatttggtgatttggttttcttgaataatatcccctatatagagctccacaatgcacatctgtgtgtcattctttaaaaaaggtaacaccttttgttttcttctgactccatgggcctaaagctatttgcagcaggtgcttaaaaatgatcgtgatataatgataatagcagaagaaaatcaatgcagatatttcaaaatagttgcagcctccaaattacttcttttagaaattggatgcagatgttgctcagttccttttgccagaaatctagcaccagtttcattcatttctctattcctctcatgtgtttttcc

SEQ ID NO: 52388 - DNA, 114 bp, Homo sapiens
tgccaggaggagcaggatgcgtataggaggatccacagccttacacatctggactcagtaaccaagatccataatggctcagatatccagaaccctgaccctgccgtgtaccag

SEQ ID NO: 52389 - DNA, 113 bp, Homo sapiens
gagtctgacgctttcctcgtttgtctcaaccacgctctgagcacagagaaggaggaagtaatggggctgtgcataggggagatatccagaaccctgaccctgccgtgtaccag

SEQ ID NO: 52390 - DNA, 257 bp, Homo sapiens
  misc_feature (2)..(2): n is a, c, g, or t
  misc_feature (5)..(6): n is a, c, g, or t
  misc_feature (8)..(9): n is a, c, g, or t
  misc_feature (13)..(13): n is a, c, g, or t
  misc_feature (242)..(242): n is a, c, g, or t
  misc_feature (244)..(244): n is a, c, g, or t
  misc_feature (248)..(248): n is a, c, g, or t
  misc_feature (252)..(252): n is a, c, g, or t
  misc_feature (256)..(256): n is a, c, g, or t
tnaannanntttnccccagaatgaagagtttcactggatggaacggcagagtcggaggagaattattcctttaatttttatttctgttgatgttgcaattgtttttatgcagtgcaagcaaacatacacacacacacacacacacacacacacacgcatgcaagctgtgaatgtttatgcatactcaggaggaagccttctcagggtcactgtttccggaaactgaccttgaaaacagaccngnattnaaanatcnc

SEQ ID NO: 52391 - DNA, 402 bp, Homo sapiens
ggtagaaaagactatgccaagaaatagagttttgggagcaagaagccccttctaatatatggtttaaaaataaaatatcgaatgattgtgtatgcagtgttgcaaaaattcagatgaacaaagtagataagttgagatatcctttataaccttaacaaaagcaacagtgatgtacctgtttctattaagcaaggaattgagaacctgctttgtctcaggcattctgtcagacaccttttacaggcattatataattcctttaccatgcttatcttttacaaaggagacagttgagtctcaggttatttaatttgcttgggattctggagccaaaagagtgatcattgttcccaggtcttctgactccaaatttcagtcccacccactgccaaggggcttcat

SEQ ID NO: 52392 - DNA, 234 bp, Homo sapiens
aaccaaatggcctccttacagctgttatcacttcttgaaactcttctctgatgaccattcccttggtttgtatcataaccctggggataacttcaccatctcctccttttcttcctgttctaaatgtagccactttgtccatgctctcttttctttatataatgcttccttaataaatcaactgccaccaaagaggaagataaaataaactaatatttatgcacattattatgt

SEQ ID NO: 52393 - DNA, 150 bp, Homo sapiens
gctcagcagctggtcaaaacaaaacatcaaagtcaccattgaaatggggcaaaaaaattaaaaactaatatgctgggacaatgccaaataaaaacgatagtctgataaacattcctcagacacattttgctcataacaactatttccttt

SEQ ID NO: 52394 - DNA, 412 bp, Homo sapiens
gttatttgtgttacagacacttctatgggtacaaaactttccctttggctatctctgataccacaaatgtcattgaaaaggacagatcctagcactaggccatatacattgataggaaccaaagacagatatctgatagattaataaatacaaccacttccaaaggtgatggtatgaagctagattcaaacaacacagtaggccagtgctgtcactcccagctcagaaccattgtggctagaagttagctttgtctttctcctcactgagccatgtgtctcagaccctggggtagagttgagggagggcagacaatggttagtttccaaactccctggacataggggccccttgctgccttctgccttcctccatagagtttagaaggtttgtttccaggaaggagctcctt

SEQ ID NO: 52395 - DNA, 358 bp, Homo sapiens
gttatttgtgttacagacacttctatgggtacaaaactttccctttggctatctctgataccacaaatgtcattgtatctgatagattaataaatacaaccacttccaaaggtgatggtatgaagctagattcaaacaacacagtaggccagtgctgtcactcccagctcagaaccattgtggctagaagttagctttgtctttctcctcactgagccatgtgtctcagaccctggggtagagttgagggagggcagacaatggttagtttccaaactccctggacataggggccccttgctgccttctgccttcctccatagagtttagaaggtttgtttccaggaaggagctcctt

SEQ ID NO: 52396 - DNA, 1551 bp, Homo sapiens
aggttaaaggggggggggctggaaaatgcagacaccaaagacccttcaatatgaggccaagaaaggaaggttcagaacagggaaaaggaaggcttccatgatcctggccacaatcctgtgaattaggttttagtattctcagtctgaagataaggaattattgatacaattcagaaaggtagagcaacttgctttaggtcacacagtgaatgagtagtgcagacaggattcaagtctgcccccttgattctgaagccaaagctctttttcctgcttggtgcaggtgagtgggaggcatggggtggatgagaagcctaggcagaggcttttcctgcatccctcctcagtttccctattcacagatgccggcctccctgtctacctgtatgaatttgagcaccacgctcgtggaataatcgtcaaaccccgcactgatggggcagaccatggggatgagatgtacttcctctttgggggccccttcgccacaggtgcaaaggtcccacctgataccccaactgggtgtccagtctcccacctctggatgcagacccacccctccattggctggccacagggagctcaccagttcctaatctgttatgctctcccaaatgaaagtcttctgctccggaagcagcagaagcagcaggagtagggtgggaggtcagtgtcccctgctctgtccgaaatcccacatcccattctgcccccaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattaga

SEQ ID NO: 52397 - DNA, 1350 bp, Homo sapiens
cgctaaaccggcaggcgatgagaaaggaaaccatcactaagatgctctggagtacccgcaccctgttggtgagggacccagctggcaggggtgctcagttcggacagggttgacccccctgttttttttaacctagtagctgctctttgcaaaggggctcccagccagggtaaggatctttcttggagggtctggggtttgctgtgggatcagatgactgcttacaggtaaggtgctcagggtcacaggggcagttatgcagcaaaatcaggggttacaatcagcagagacagaaactttcccaggaagctccctttctccccctcccaggccaaaaactcctggggggctgagcatggatccaagtcactggtgggcccacctctggcccagctggcacccaggcctcaggtaagtgtggcctcctcactcagaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattaga

SEQ ID NO: 52398 - DNA, 1411 bp, Homo sapiens
cgctaaaccggcaggcgatgagaaaggaaaccatcactaagatgctctggagtacccgcaccctgttgaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagatgccggcctccctgtctacctgtatgaatttgagcaccacgctcgtggaataatcgtcaaaccccgcactgatggggcagaccatggggatgagatgtacttcctctttgggggccccttcgccacaggtgcaaaggtcccacctgataccccaactgggtgtccagtctcccacctctggatgcagacccacccctccattggctggccacagggagctcaccagttcctaatctgttatgctctcccaaatgaaagtcttctgctccggaagcagcagaagcagcaggagtagggtgggaggtcagtgtcccctgctctgtccgaaatcccacatcccattctgcccccaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattaga

SEQ ID NO: 52399 - DNA, 804 bp, Homo sapiens
agtgcttctccttacccatgaagatggctgtggcgaaggggaaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattaga

SEQ ID NO: 52400 - DNA, 1978 bp, Homo sapiens
aggttaaaggggggggggctggaaaatgcagacaccaaagacccttcaatatgaggccaagaaaggaaggttcagaacagggaaaaggaaggcttccatgatcctggccacaatcctgtgaattaggttttagtattctcagtctgaagataaggaattattgatacaattcagaaaggtagagcaacttgctttaggtcacacagtgaatgagtagtgcagacaggattcaagtctgcccccttgattctgaagccaaagctctttttcctgcttggtgcaggtgagtgggaggcatggggtggatgagaagcctaggcagaggcttttcctgcatccctcctcagtttccctattcacagatgccggcctccctgtctacctgtatgaatttgagcaccacgctcgtggaataatcgtcaaaccccgcactgatggggcagaccatggggatgagatgtacttcctctttgggggccccttcgccacaggtgcaaaggtcccacctgataccccaactgggtgtccagtctcccacctctggatgcagacccacccctccattggctggccacagggagctcaccagttcctaatctgttatgctctcccaaatgaaagtcttctgctccggaagcagcagaagcagcaggagtagggtgggaggtcagtgtcccctgctctgtccgaaatcccacatcccattctgcccccaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattagacctgaatttctccacctataaaatgggtgtgtgaagtgaatgatgtctcaatttgagccctgagagaaaggaagtattgctgcctgttccttagtgggctgtgcctggatgctacactcagtcaaagggtgctactgcaaagttgcctggggtacaaaacacttgccttttgccttcatggtctcaagtgcacccctcaggacagccacaccccacgctcacttgtccatcagtttaggtcttagtgccacatctagattcctctggcctctcctgcagcccgtgtgtatcccagcctgggtgacagagtgagaccctctctaccgccttggcctccataagtgctggaattacaggcacaagctaactgctcggcccctatgcctatttcgatgctcctgaataaagtctgctttactgagcttta

SEQ ID NO: 52401 - DNA, 1585 bp, Homo sapiens
cgctaaaccggcaggcgatgagaaaggaaaccatcactaagatgctctggagtacccgcaccctgttggtgagggacccagctggcaggggtgctcagttcggacagggttgacccccctgttttttttaacctagtagctgctctttgcaaaggggctcccagccagggtaaggatctttcttggagggtctggggtttgctgtgggatcagatgactgcttacaggtaaggtgctcagggtcacaggggcagttatgcagcaaaatcaggggttacaatcagcagagacagaaactttcccaggaagctccctttctccccctcccaggccaaaaactcctggggggctgagcatggatccaagtcactggtgggcccacctctggcccagctggcacccaggcctcaggtaagtgtggcctcctcactcagaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagatgccggcctccctgtctacctgtatgaatttgagcaccacgctcgtggaataatcgtcaaaccccgcactgatggggcagaccatggggatgagatgtacttcctctttgggggccccttcgccacaggtgcaaaggtcccacctgataccccaactgggtgtccagtctcccacctctggatgcagacccacccctccattggctggccacagggagctcaccagttcctaatctgttatgctctcccaaatgaaagtcttctgctccggaagcagcagaagcagcaggagtagggtgggagaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccacactccaaagtctatacacaggggtggtctcttcaataaagaagtgttgattagacctgaatttctccacctataaaatgggtgtgtgaagtgaatgatgtctcaatttgagccctgagagaaaggaagtattgctgcctgttccttagtgggctgtgcctggatgctacactcagtcaaagggtgctactgcaaagttgcctggggtacaaaacacttgccttttgccttcatggtctcaagtgcacccctcaggacagccacaccccacgctcacttgtccatcagtttaggtcttagtgccacatctagattcctctggcctctcctgcagcccgtgtgtatcccagcctgggtgacagagtgagaccctctctaccgccttggcctccataagtgctggaattacaggcacaagctaactgctcggcccctatgcctatttcgatgctcctgaataaagtctgctttactgagcttta

SEQ ID NO: 52402 - DNA, 1265 bp, Homo sapiens
cgctaaaccggcaggcgatgagaaaggaaaccatcactaagatgctctggagtacccgcaccctgttggtgagggacccagctggcaggggtgctcagttcggacagggttgacccccctgttttttttaacctagtagctgctctttgcaaaggggctcccagccagggtaaggatctttcttggagggtctggggtttgctgtgggatcagatgactgcttacaggtaaggtgctcagggtcacaggggcagttatgcagcaaaatcaggggttacaatcagcagagacagaaactttcccaggaagctccctttctccccctcccaggccaaaaactcctggggggctgagcatggatccaagtcactggtgggcccacctctggcccagctggcacccaggcctcaggtaagtgtggcctcctcactcagaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagatgccggcctccctgtctacctgtatgaatttgagcaccacgctcgtggaataatcgtcaaaccccgcactgatggggcagaccatggggatgagatgtacttcctctttgggggccccttcgccacaggtgcaaaggtcccacctgataccccaactgggtgtccagtctcccacctctggatgcagacccacccactccaaagtctatacacaggggtggtctcttcaataaagaagtgttgattagacctgaatttctccacctataaaatgggtgtgtgaagtgaatgatgtctcaatttgagccctgagagaaaggaagtattgctgcctgttccttagtgggctgtgcctggatgctacactcagtcaaagggtgctactgcaaagttgcctggggtacaaaacacttgccttttgccttcatggtctcaagtgcacccctcaggacagccacaccccacgctcacttgtccatcagtttaggtcttagtgccacatctagattcctctggcctctcctgcagcccgtgtgtatcccagcctgggtgacagagtgagaccctctctaccgccttggcctccataagtgctggaattacaggcacaagctaactgctcggcccctatgcctatttcgatgctcctgaataaagtctgctttactgagcttta

SEQ ID NO: 52403 - DNA, 491 bp, Homo sapiens
ggattccccgggctgcacgattcggcacgagaagctccctttctccccctcccaggccaaaaactcctggggggctgagcatggatccaagtcactggtgggcccacctctggcccagctggcacccaggcctcaggtaagtgtggcctcctcactcagaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgaggtatgcagggtccccaagagtggccacactggccccgtccactctccaggtgtgctgtttaccaactgggcttatcgactgctcccctaccctctctgtacttctgggctagtataggattctaagatatcacagaggaggcagcatgctatcaactacaagagaggaaggggccagg

SEQ ID NO: 52404 - DNA, 1552 bp, Homo sapiens
cgctaaaccggcaggcgatgagaaaggaaaccatcactaagatgctctggagtacccgcaccctgttggtgagggacccagctggcaggggtgctcagttcggacagggttgacccccctgttttttttaacctagtagctgctctttgcaaaggggctcccagccagggtaaggatctttcttggagggtctggggtttgctgtgggatcagatgactgcttacaggtaaggtgctcagggtcacaggggcagttatgcagcaaaatcaggggttacaatcagcagagacagaaactttcccaggaagctccctttctccccctcccaggccaaaaactcctggggggctgagcatggatccaagtcactggtgggcccacctctggcccagctggcacccaggcctcaggtaagtgtggcctcctcactcagaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagatgccggcctccctgtctacctgtatgaatttgagcaccacgctcgtggaataatcgtcaaaccccgcactgatggggcagaccatggggatgagatgtacttcctctttgggggccccttcgccacaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattaga

SEQ ID NO: 52405 - DNA, 465 bp, Homo sapiens
gatccaggcgtgcctcgtgcctgtcctggcctggtctttgctgtgactctttgcacacttgtatctccaccccctactgagagtttctctctggatccctaacaaaacccagcttacgcctcatacacagcaggggcataataagcaatgatggcatgagttggcaaggccttctcactactcattccctggacatggttcctgcttctgcctctctgtgcttcagagatagccccacacaatgcacccctttcctggagggcgtgggccacctgcacacccttctgagcctggaagatggcatgcgctttcaaagagccgaaactgagaggaggcatggggaggtgaccctggcatcctgcttccccactgcatcccaacacatatgaccttgatttggagaagcggtgagctggaccaggactgcctgtaggcctggctccagccctagatgtcagccacttc

SEQ ID NO: 52406 - DNA, 441 bp, Homo sapiens
acaataacatgtaatgatctatgatgatgcaaacactctatacttgtaaaatgatttaaaatttcccacttgttaactgaaggatgtacgcggtggtagagacatgtatgtctctattcttttaaatctgaaagcattatctaaaacccaatcatcatatacctgtagggaaaaagcctaacacagccatatccaaaagtcatagtccgtcagaagtatgttaaatgttataaaattacttgacctcagcatttctgagttttggtgttttcaatttataatataataggtggttggtttattttaaccaaacttaaaaagcaatgatgcctgcaaagcctctgattggaccaaaagtcaccatttatactctgacattgaggccaggcacgctaactcacacctgtaatcccaacaatttgggaggccaaggtgagagga

SEQ ID NO: 52407 - DNA, 200 bp, Homo sapiens
taaaatcattttttgtctaaatataatcttcacacatgattaaaatttttactaggtgaagaattactaattggaaacaatttcctctgagaatgttgaaagcattattccgatgtgttgttgcttctagtgttgctttagaaatgtctgatttctaattttctacatgtaacttttatctgcaaggttttctcttggcc

SEQ ID NO: 52408 - DNA, 358 bp, Homo sapiens
aaacacacacatccacagatttatatgcgggagagaagatgtggtccctggcctctaggctctctcagtctgtggcaagacagacagacatgtgcacgcggcactgtaaggttgagcacagtctaagtactcagcatggtctctggcacatagtaggtgcccaagaaatacatgtcgaatgaattgagggggtaaggccttctagggcaggtggcctctgacctcagccttcagtgttccgtaggtggaattatctgccagagacgtggcaaaagggagaggaaccaagactgaggcacagaggttcaaacgtacccggcacattcagagaatccttttcagaatcacgtccccaaga

SEQ ID NO: 52409 - DNA, 304 bp, Homo sapiens
ttgatatgtatgtgtatgtatatgtacatgtgcatatatttctgtttgtgtgtgtgtatatgtgcatgtgtgcatgcgtgtgtgtgtgtttccttattcaatttcctgcctcagcctctctggtagctgggattacaggactaccgtgaggatggattggacattacaccacactggaaaagtgaaacatctcattcagttggtgatcttcctgtcatgaaagttgcttgacagctctaattacgaattgaacacattaaacacctggtgaaattatcaattaaaaacatctagtcaccataaa

SEQ ID NO: 52410 - DNA, 299 bp, Homo sapiens
atcccagcactttgggaggctgaggtgggcagatcacctgaggtcgagagtttgagaccagcctgaccaacatggagaaaccccatctctactaaaaatagaaaatcagcctctctggtagctgggattacaggactaccgtgaggatggattggacattacaccacactggaaaagtgaaacatctcattcagttggtgatcttcctgtcatgaaagttgcttgacagctctaattacgaattgaacacattaaacacctggtgaaattatcaattaaaaacatctagtcaccataaa

SEQ ID NO: 52411 - DNA, 2103 bp, Homo sapiens
gggatgtctctcccaagattccaaagagtaaactttgggccatatgataattacattccagtcagtgaattaagcaaaaaatcatggaatcagcaacactttgccctgttatttcccaaaccacaacggccaggaaccaaaaggagatcaaaaccttctcaaatacgggacaacacggtttctataattgatgaagaacaattaagaggagatcgtagacaaccattatggatgtaccgttctttaatgagaatttctgagagaccatctgtttatttagctgccaggaggcagcctctcaaaccaactcgtactgtcgaggtggattctaaagcagcagaaattggtaagaaaggtgaagacaagacaacacagaaggacacaacagattcggaatcagaattaaaacaaggaaaaaaagattcaaagaaaggcaaggatatagagaaaggaaaagaagaaaagctagatgcaaagaaagatagcaaaaaaggtaaaaaggatgcagagaagggcaaagactcagcaacagaatctgaagatgaaaaaggaggtgcaaagaaagataacaaaaaagataaaaaggattcaaacaaaggcaaagactcggcaacagaatctgaaggtgaaaaaggaggtacagagaaagatagcaaaaaaggtaaaaaggattcaaagaagggcaaggattcagccatagaattacaagctgtaaaagcagatgaaaagaaggatgaggatggaaaaaaagatgcaaacaaaggtgatgaatcgaaggatgccaagaaagatgcaaaggagattaaaaaaggtaagaaagataagaagaagcccagtagtacagacagtgactcaaaggatgatgtcaagaaagagtctaagaaggacgccacgaaagatgccaagaaagttgccaagaaagatactgagaaagaatctgctgattcaaagaaggatgcaaagaaaaatgctaagaaggatgcaaagaaggatgcaaagaagaatgcaaagaaggatgaaaagaaggatgcaaagaagaagggcaagtaggccttggataagaatttgaaccgaaagaataattcaaaagcatatttgatgaaacaatagtggtagtctgcagctgaatttgtgagaaaacaagaggcctcaaagaattaaataatttttaaaaggtggtaaagaaggatacaaaggagaactcagcagagatttataaaaatatataagaaagatgttaagaaaaattaaggggggatccattgaaagacttgaagaatacatatacttatattcggggatatgaaggattcaatgaatgatctctagaaagatttaaagaagaatattcagataaggatgttgaagataatgacactaaatctatggacacacacacacacacacacacacacacacacacacacacacacacacacagtttaatgaaggcttaaagaatccaaggagacagatgttgtatctatagatttaaaataatctcaagctgcatccacagatacaaaaaaatataggagccatgaaatgaagttaaacaccttgtagaaagcctactttcaagtaaatatagcattcctttggcaaaaaaaaaaaaaaaagtaaaagaaaagaaaaaaaatgtattaccacccgatgagcctacatctttctttctgaagtttaaacaaccacagtcatgtttatggttgttggatgtgccacttccaatccaaaagaagcacacttgtctcgctctgttgccctggctggagttcagtgacatgatctcaggcttactacagcctccaccttcaggttcaagtgattctcctgcctcagcctctctggtagctgggattacagggaaggaaaatagctggcatttcttgctggagaaagttatcacaagtggaaaggttaccctagaaacaaaagatgactaccgtgaggatggattggacattacaccacactggaaaagtgaaacatctcattcagttggtgatcttcctgtcatgaaagttgcttgacagctctaattacgaattgaacacattaaacacctggtgaaattatcaattaaaaacatctagtcaccataaa

SEQ ID NO: 52412 - DNA, 262 bp, Homo sapiens
catctctacaaaaaataaaaaaattagctgggtgtcgtagtgtgcgtctcaggaggcagaagtgggaggactgcttgggcccgagaggttgaggctgcagtgagccaagatcatgccactgcactctagcctgggcaacagagtgagactctttttcaaaaatacaaaataaaaaagaaaaaaagaaagaaaagactatactccaggactgctaatttttaaaataaactgatatagaaaagtaaaaactcggaaggttaat

SEQ ID NO: 52413 - DNA, 190 bp, Homo sapiens
ttacagttgtgagccatcacgcccggccttttttgatatttctaaactatgtagttcattgtaatatttttcaaattgtctcagatctcaaaaaaactttagaatatatttattgaaaaaaatctgcacataagtggtactatgcagttcaaacccatgtcattcaacagtcaactgtattgtatactca

SEQ ID NO: 52414 - DNA, 221 bp, Homo sapiens
ttttaacttgttctttcaaatcaagcttggggaagagaaaaatacatccttgccattgtctctgagagatttaaaattgactccactagtagctcagggatggacatggcagcagggattggtgtaagattccactcttctgctagttaaattgggcctggaaccactacagaaattccatccactactttgagaacaacagtccccagcccaggctttct

SEQ ID NO: 52415 - DNA, 437 bp, Homo sapiens
aggtgatacccccgccttggccacccaaagttctgggattataggtgtgagccaccataccccaccacagatgccctattcttttacagaaaaagtctggagggagctcccatcccttctacttatgtcctatgagctggaatttagttgcatgtcttatctagctgctagggagaactgagaatttattactagtagtgtgccacagttcagttcagagctctgaaactgactaaaaatgaaaacatttttaataggggtttcattctcagtgccccagttttgctgtttatgtagtattatctcaaagctattggatgagttaatgcaggtaaaagtacttagtacctggcacaaagtaagccttcagtaagtgctctaaatatcactatcttcatctttgtgacctgatagcaacagtgacagcaatccatagt

SEQ ID NO: 52416 - DNA, 157 bp, Homo sapiens
atggttaaattttaaaggatagcaacaaattgggggcattttttaacaatattatttgggctattctattacttgccgcataaatacatttaccttatctacagagcttggaaagacactgatgctgaggataatttcaaacaggaagtagaataca

SEQ ID NO: 52417 - DNA, 289 bp, Homo sapiens
taataatatggggtttttgtttttgcattttttttttgtggtgattattacttcatagcaaacttctctctgctggtgttttgctgttttgcttatctccactggggctgggttataatagcttggagatgtttgtttcctgtttgtggaatgtctgactttccagctcactttgcccacaggtttgaggctgatagattccaggaaaataggaagaattccattcaaaataccataaaaatggagcaggctacaagacttttgagataacactactgttaaatttttt

SEQ ID NO: 52418 - DNA, 441 bp, Homo sapiens
gctatgaggccaacgaggccaatgatttattgattgagaaataaagggaattcctctctgtcttcttctaaatgatcggtttccaacttctaaacactcccagatgtggaatgcatgtttcttccttccattcctctctgcaggctgccctgacatttgttaaattggctcctgggtcctggtttgcaaatgttgccactttgagatccgtagatggtcatccctggctcccttggggaatgtcctggaatccaccagctccatctgctcgacaagagacttgagtttgttctgttacctctttcatcattagccaaagctccgggacttggttaaaactttaggcaattaaaaagactgacttatggagatagtagtgttttcactatatcgtccctgcttgaatttatgttcttgaattccattaacctgaaatatatc

SEQ ID NO: 52419 - DNA, 490 bp, Homo sapiens
gctatgaggccaacgaggccaatgatttattgattgagaaataaagggaattcctctctgtcttcttctaaatgatcggtttccaacttctaaacactcccagatgtggaatgcatgtttcttccttccattcctctctgcaggctgccctgacatttgttaaattggctcctgggtcctggtttgcaaatgttgccactttgagatccgtagatggtcatccctggctcccttggggaatgtcctggaatccaccagctccatctgctcgacaagagacttgagtttgttctgttacctctttcatcattagccaaagctccgggacttggttaaaactttaggcaattaaaaagactgacttatggagatagtagtgttttcactatatcgtccctgcttgaatttatgttcttgaattggtctttcacacgtaaaccccgcggggcggggcgtgctacgtgtgggtgtgagattgattacactgtcc

SEQ ID NO: 52420 - DNA, 872 bp, Homo sapiens
agcactggaattccaggcataagccaccgtgcctggccaagaacgtttttttttttaacaagtttctaaatgatgctggtctattggtcctgggaccacactttgaaattggtgggataggaggctgggatctttatccattcactcaactcccattccccatggttgaaagtttccctggggcatccctgggaggcctgggggctgacaagattcaaacgttttggtgaaaagccccaagacagtgaagtggggtgtgcttgaagtggggcaccgtcatcacccacctacccaccacagaggtgagctaaaaggttaccagaccggagcctccagcaatccaggagcacaaacaaggatgccttaaaacaaaacttgtgtcagggtacccttcgctgcctcagaggaaatcagaatgacctggtggacaactgttcataaggacaagagccagtatcactgcctttgagtcccagcctcctcaaatccattttctgccctgcaccacctcatcatatcccggatattgttagtgtcgtgtcatttcatgactcaggagctgcgggtgactttggctgccctgacatttgttaaattggctcctgggtcctggtttgcaaatgttgccactttgagatccgtagatggtcatccctggctcccttggggaatgtcctggaatccaccagctccatctgctcgacaagagacttgagtttgttctgttacctctttcatcattagccaaagctccgggacttggttaaaactttaggcaattaaaaagactgacttatggagatagtagtgttttcactatatcgtccctgcttgaatttatgttcttgaattccattaacctgaaatatatc

SEQ ID NO: 52421 - DNA, 328 bp, Homo sapiens
cttttttcatgttttggatcatgagaaggggtgaaagttggattctaggagataatcggcccagaattttaactaaggtgtggaatgaagcagtcttctctcactagattttgcttgccctaaagatgcaacatctgccctgtaaacacaaatgcagcatgcatggcaagccctggagtgacgcctcaagttggagaccatagaatactagagaggcacacccaaacctttgaattccctccagccctggggatctcctgaaagggcatattctgattggggactgggctggggttcaagattctgcatctctcagcagctcccaggg

SEQ ID NO: 52422 - DNA, 439 bp, Homo sapiens
catttattgaccagtgctgtgtgttcacaactgtatttagactagtggtatagcagtgcagtagtctgaaaacattttctcatctgtaaacaaagacagtcatacctcctaggactgcaagaagtcactgaacatatacctggcccttagtgtacacattactaaagagaataagatgtggtctgcaccctctcatgcaccagtggcttcttgagcagtatgatagagagagacagctgagatttagtggaaaaacacaaggcttagaattgggagagctgggttcaagccccagctttgccactaaatggctgtgtagtcttgaacaagtcacctgccctctctgagctataatttgaaatagacttagcttaagcaacaggaaagcagtaatgagctagaagataggctcactcagggggagaggggagctgctgca

SEQ ID NO: 52423 - DNA, 533 bp, Homo sapiens
taccattccaatttgaaatggactgtgtacacgcttcatttagtacttttgtaaactgtgtttgtgatctgacagcagcctgtgaaattcataagaatcacataggatgtaaatctccatgatgtatgccaattacagaaattaggttggtctgtgtctttgttactaacaaaaatagctatagcagtggccttcagagatgtagagtctggaaaaacttgatcttaatgtcaggttctggcactgcttttacagttatagccctgatgagagctatcagtagggaaaataatttatgggagaaatttaattttgctaaaagagataaaagtttatgctcataaccctaatgtagtttttatccattatgaggccacaaactctttgagaatctgctgaaatctctattaagaaactgccaaagagcatacacaaaatttgcatgcaatttcagggaaggtcttcaccccagttcccacactaccccctatcctccattattccctcagacttagaatgtcagtcctaataga

SEQ ID NO: 52424 - DNA, 258 bp, Homo sapiens
aaatttctctaagcaagcctcatgggagattctccaagaacacctttaacaacagaatttcccctagaaatgccacatcgaaagtcatattcccagtggagatttctatgggaattgggaagttaactagatttgctgttttcacacctgctgagggttttgagtctagggaattaagtttgtcatagctagacattttacctttgccaaaccagtctattgtatgaaacctaagttgccatcaaaagctggaaagga

SEQ ID NO: 52425 - DNA, 538 bp, Homo sapiens
cgagattgttgttggctgaacatcttttaattctgagttaccaacacgttgtgcgtgcattgatgacccggcttcctggcctgcccttggtgcctgagccccagtaatgattgccctctatgttgggagaagaagggagaaagtagtacaagtagtgaagaaaaaaatgtaggtggtgttggtggttgagagtacatggcacagaaaataaaggagccaggattacctgtgcctttggcttctccttcccctgctgctttttcttcctttttccatgtcagtgcttgggaaccctcacaactggcaggtaacggggtcgggataaaatgtaaacctgtgggtgtcttctgctgagtcattaggatctttgtagcaggctgcggataaatatgtggatgacatggggcaactaagagccccttttgcttgccacctcccacccctgctctggatggtgtctcctcttgctagactgccgggtacagatcacgtggcaattaaggcaaatgttaataaataccatgaaacagtgagtttg

SEQ ID NO: 52426 - DNA, 144 bp, Homo sapiens
gggagagggaggagtcagataactcagaatttctagcagacccagtgggtggatagtaatgccatcattgagatatggaggacactggaagagagccaggtttgggggaagagggtaatttcaatttgaacacgttaagtttaa

SEQ ID NO: 52427 - DNA, 653 bp, Homo sapiens
actttgaagatgaatgtgagatattttaagagataaatcatagcaattgaaaagacataattttaaattctgagctaaaattcatttaaaattagaaaattaaacaatactctaatttaactaaaaactctataattttcaaaaataaagcccaaaatagaaatgtaggaaaaagatcctttgctactgttaaaaaaaaaaaccccatcctgatgtggcccacattcttatttgattctagttttatctgagcaagaggaaaggaaaagggttgtacttcagttaataaagacttaaaattctggaccatcaagtgtaaatttaatataaataattttatttaaagataaatggccaggaagtactctgcaaagtaacaacagagtattattaatgctgataattacatggaaaatcctaagactggccatgtaaaagctttgattaaaatataattcaaattacagatgatgtaataacatgaagctggtggtaggatcctcaggagccataatgaacagtgtaagccagttcacaaaaggcaggcatttttacagatccttatgtttcaatttcatgctctattcacgtgaagtaaatataacatcacagtgtaccaattaaatggccataatgagaacattattcctcaa

SEQ ID NO: 52428 - DNA, 250 bp, Homo sapiens
tttcctctcctcctccctccttccctccctccattctatatttgttcaattttgcagcaggtgcaaccactgctgtgtctcgcattttgcagatgaggaaactgaggctcaaagagggtccaggatcagcttgcctggatctcaaacaggggaggctgagctctcaggctgtctggcttggaagtgggtgggaggcgggacagtgctggacttgaacttggttctgggtagagccagccagagcctgtgt

SEQ ID NO: 52429 - DNA, 3110 bp, Homo sapiens
  misc_feature (709)..(709): n is a, c, g, or t
agacctcggcacccgttcagactgacagcagaggcggcgaaggagcgcgtagccgagatcaggcgtacagagtccggaggcggcggcgggtgagctcaacttcgcacagcccttcccagctccagccccggctggcccggcacttctcggagggtcccggcagccgggaccagtgagtgcctctacggaccagcgccccggcgggcgggaagatgatgatgatgtccctgaacagcaagcaggcgtttagcatgccgcacggcggcagcctgcacgtggagcccaagtactcggcactgcacagcacctcgccgggctcctcggctcccatcgcgccctcggccagctcccccagcagctcgagcaacgctggtggtggcggcggcggcggcggcggcggcggcggcggcggcggaggccgaagcagcagctccagcagcagtggcagcagcggcggcgggggctcggaggctatgcggagagcctgtcttccaaccccaccgagcaatatattcggcgggctggatgagagtctgctggcccgcgccgaggctctggcagccgtggacatcgtctcccagagcaagagccaccaccaccatccaccccaccacagccccttcaaaccggacgccacctaccacactatgaataccatcccgtgcacgtcggccgcctcttcttcatcggtgcccatctcgcacccttncgcgttggcgggcacgcaccaccaccaccaccatcaccaccaccaccaccaccaaccgcaccaggcgctggagggcgagctgctggagcacctgagtcccgggctggccctgggcgctatggcgggccccgacggcgctgtggtgtccacgccggctcacgcgccgcacatggccaccatgaaccccatgcaccaagcagcgctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgccggcatttagaagactcttggcctctccagagacgcccctttcctcgtccgctcttttctctcctctcttctgcctcttttcacttttggcgactagaaacaattccagtaaatgtgaatctcgacaaatcgaggactgaagagggagcgaacgagcgaacaactgagcccaagccggtgagaatgtgaaacagtttctcaaaggaaagaataacaaaagatggtatttgtctgttgtagcaaagttgtccctttgaaccccacctcggcttcttcagaggaagtgtggagatggctgtttgcaggaaggcagacgagacagtgtttaaaaagtccacaagaatgatcaagtaagatttgtttttattcttacagacatcacccgtgttcaagtttaaaagtacactttgcaactatttttcagaaatagaaattgattcaggactaaaactttaaactagagttgatgcttaatgtgatagagacatctctaaagtattttgaattttaaaaaaagatggcagattttctgcatttacactgtatattatatatatatttttattgtggttcttacccccttttccttctctgaagtgttaatgcttaagaaaagagttgcgcctgctgtgttcactgatcttgaaagctattattagattattgcagaacaaccctctgtaaattattaatttatctctctagcaacttaattttgtgcacattctaattaattaaacttcttccgtctaaaaaaagtgggggaaatgtatagctagtaacgttcaaaaaattttgtttgatgagtttaccgaatttttacagctttcctcctatactgtgttccttttgacccatttgtatattctcacttgaatgaagattgtttttttctttgtttttactggtagtgttctgatttgtgagtcgacactcagtaatggatgtcttaatcgtgtagacctgattcactgtctgaagtattgtttacttcgttacatatttaatggggattcccacattgtccccatgacacatgagcgctctcacttacccttacacacacacacacacacacacacacacctctaacagaagggaagaagcagttggaagcatgaccgatgcaccattttctagttttaggtgcatttgccacttggtgtttgcccttcagattttagatttcaccaaggtatttcagtcttccagttttcaattgctttgttggctacatgttaatatttataggaatacttcagtttttccttttggaggtttgtttgtagaaaaactaatttgaactataagaaagacagtgcactgcttgtaaattcacattgtttggaaaaattcttttggaacaaaaaattaggtacatgataactggtaccttatctactgtaaatatttcattaaaaatgatgcacacatagatatattcttacaaattttgctgtattgctgttctctttgaggctctccaaagtcttgagttctgtatatggcctggtttcttgtttttattaatagatggtttatttactatggtaatgtattaatttatttttggtgttgttcgattgtctttcattgaagagataattttaatgttttattggcaacgtatgctgctttttcattaaaatatgctattaaaattaaatggctttta

SEQ ID NO: 52430 - DNA, 106 bp, Homo sapiens
ttgcataggggttcttaactaagacctctaccttcttcatccaactccaagtatattggtttacttcatttttattacaagaatatggtatcatcgtagctttata

SEQ ID NO: 52431 - DNA, 341 bp, Homo sapiens
tcaggttgggttctcctagaagcaggctgtgagcctatgatttcagtgcaagtagttaatagggaaggtgaagggaatactgctagaggagtaggaaagtgaggcaaaggagggaaggcattgaacaaagggcataataccaagacagctacagtcggggcaactgaagcttaaccctgctggaaaattctgggaacttaggcagaatttatctcagagttagtctacctagcggtgagggagctggggtatttacacttcaacatccctaatgcctccagtctgctgtgtggattgtgactcaggcccaggagcaagaaaaaaccactggcagagaaatg

SEQ ID NO: 52432 - DNA, 211 bp, Homo sapiens
ttttctataacattgccagaaaatagtgtcgtggagctgaggctaagttttaagggaaaaaaggttgtaactaagaattaaatagtcacactaattgttgttaatttgtgaaggcagtgtgctagctccaccttctgtatcttcagggaccatctttcttgctgccttcacaaattacccattgcttcctccagcttggcaggaacccttg

SEQ ID NO: 52433 - DNA, 1060 bp, Homo sapiens
  misc_feature (772)..(772): n is a, c, g, or t
gcgagcggcccgcaggggctggtgtcactggtcattcctgcacaggacagtccaccatggcctcagatcaccagacccaggcgggcaagccacagtccctcaaccccaagatcatcatctttgagcaggaaaactttcaaggccactcgcatgagctcaatgggccctgccccaacctgaaggaaactggcgtggagaaggcaggttctgtcctagtgcaggctggaccctgggtgggctatgaacaggccaactgcaagggcgagcagtttgtgtttgagaagggtgagtacccccgctgggactcatggaccagcagccgaaggacggactccctcagctccctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgcgggtgcagagtggcacgtgggttggctaccagtaccccggctaccgtgggctgcagtacctgctggagaagggagactacaaggacagcagcgactttggggcccctcacccccaggtgcagtccgtgcgccgtatccgcgacatgcagtggcaccaacgtggtgccttccacccctccaactagtgccctccccaccatgcctccttcccaggacccaggtctgctgcccaggaaccctccagacctcccagagagtgaataaagtgtgacttgcaacttgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaagtttccttgggggggccaaagtttacccttccccattttttttgtaaaagggggcccttttggggggggtttttataagttgggccttgcccgttttttaaaaacttttgaatgggaaaaactgttatttgggaatttttggaagggacccttatttttggggggg

SEQ ID NO: 52434 - DNA, 1110 bp, Homo sapiens
  misc_feature (822)..(822): n is a, c, g, or t
caccggcacttctggggaaggtataaatgccacctcccgctggccgagcttcacggcactcgcaggggctggtgtcactggtcattcctgcacaggacagtccaccatggcctcagatcaccagacccaggcgggcaagccacagtccctcaaccccaagatcatcatctttgagcaggaaaactttcaaggccactcgcatgagctcaatgggccctgccccaacctgaaggaaactggcgtggagaaggcaggttctgtcctagtgcaggctggaccctgggtgggctatgaacaggccaactgcaagggcgagcagtttgtgtttgagaagggtgagtacccccgctgggactcatggaccagcagccgaaggacggactccctcagctccctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgcgggtgcagagtggcacgtgggttggctaccagtaccccggctaccgtgggctgcagtacctgctggagaagggagactacaaggacagcagcgactttggggcccctcacccccaggtgcagtccgtgcgccgtatccgcgacatgcagtggcaccaacgtggtgccttccacccctccaactagtgccctccccaccatgcctccttcccaggacccaggtctgctgcccaggaaccctccagacctcccagagagtgaataaagtgtgacttgcaacttgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaagtttccttgggggggccaaagtttacccttccccattttttttgtaaaagggggcccttttggggggggtttttataagttgggccttgcccgttttttaaaaacttttgaatgggaaaaactgttatttgggaatttttggaagggacccttatttttggggggg

SEQ ID NO: 52435 - DNA, 236 bp, Homo sapiens
ttcggtacaggctgacttccttgagtcagcatagggtcacagctatgggacagggctcagcacccagactgtgttcaaatcctggctctgctacttacccgctgtgatcttcagaaaggtacttaaccttcctaagcctctgtttcctcatctgtaaaatggggataatggaagctaccttatgtggtcattgcaaagacttcattagaattgtatctatcatgcctggtgtataa

SEQ ID NO: 52436 - DNA, 391 bp, Homo sapiens
tcaactgcaaaatcccttcccatcaacactgagattactgcgtgactgagtaactgacagaagatgtgtgtataccagggccaaggaattttgggggtcatctcagaattctgcctctgttaggccgatgttataggatttttatttgcattttaaaatcatattccattgttaaatatatgccacaatttctttatccatttgtctgttgatggatgcttagattgactcctgtttctttcaggtcacccaacacttgcagtgttggattcccttaaggttttcttggagtagtgaggttctttgaaaataagtgcagcgtcttgggtgaggggtccagtcctggttgtgttgagtgacgggagagctgcaccctggtcctgcctcgaag

SEQ ID NO: 52437 - DNA, 95 bp, Homo sapiens
atggtgagtcccctaaggacagggcttgggacctctgagtgtagcccctgcgcagaggggtctggcggcacacacctgtggagtgaacagttaag

SEQ ID NO: 52438 - DNA, 1076 bp, Homo sapiens
catctcagaaatttttctcttttgaggggagatcaaatatccagaattctctagactggagcaggggtttttcaaacaacagcagcagactcacctgtaatcttgtcagaagtatgaattatcagtctccaccctagacttactgaatcagacactgtgggagttaggcctagcagtctgtatttactaggtgatccggaggcatgctagtttgaaaactgctgggctagagaaggtctgctgaggatgtgatacattcctcactaatttaaggatttgactcagaagccatttaattaaaaggatctgctgggtcaagggaaaggggaaaaactcatatgaatttaattgcctggtcctttcaagagtcagaaggtacaaatatttatttagtttgctcacagagtcgagaattttgagactagtggtaacttctttcgccagtccctaatgacatcacgttagagggtgtgggacagtgtgattaactctaagtgtttaaggtcttttgccataggcatcgccacttaagctgtatgtttttaatgaacctggaattccagcatgctcactgcccagacgttattgtatttttgttcactaattcaccgagcatataatgagcacctacttattgtgagacacaagatgagtaagacatggtccctgtgtttaaggaatgtatcattcagtcttgagaaataccccagaacatgacgctttcatatgctcacagatgtgtgcttttctaaacatatccaagctgctacccacagatctgatgtaaacctggccttgtagtcagagctcagctaccttttagcattatttggagcttaattcttttaccttacctgtccccctttttttcccttttgatatactgtttagtttactcctgagatacttgctatctcatatgaaaatgtctttcaagacctcgtaagtttaagaatgagagccagcttcctattatggttcatttttggagaaattccgaataaagactgatagatggattcccttaagggaaataattatttaaactattaattttctaatgaaaagaacttagt

SEQ ID NO: 52439 - DNA, 407 bp, Homo sapiens
agcttcaataccctgtctctaaaagttaaataaataaataagaataaattaaaatccagatttccagcatcttttccaaaaagtgtcaaaagatccaaggacactgggcccacttcctcacatggcaacaagcaagtggagctgagcagcaactgctccctttagtttgggcccgtgctctccagttcatcaaggcccagcctactcatcctagtacataacaggcatcggacttggagaccactgaggaagatgctcaaacagaacaataataataatttaatgaagatttgtttactcttttttggccagttttttgtgggctctattcacacattagctctgtgactcttaagtaacatatttaaccactaagcctcttaaatttaacacaagctgaaatatgc

SEQ ID NO: 52440 - DNA, 764 bp, Homo sapiens
gtgaagtttgagaagttatgaaagatttatgacaaacatttttttctcctcacggtcttccgtgttatttataattacatgaatcttaaccagaggttttattgatttcataatgaattcaaataaagattgcagctcctcagcgacctttaaaggttagactggctatgcatgtttttttccaaaagtttttgtcgtgatagaatttattttttaccatggaagtattcagacatagtagggtcacttcagactgtaattatcactgcaaggcttatgaaataagtgaccaacacagtctctatcacacacacacacacacacacacacacacacacacacacacacacttatatattcagaggacttctttataatagttcttattccaagcaagccatgtaggagaaatgttgtcacttttgtgagggcatataacatgagcaacctataatggatccctttttttggtgtttgccatctcttagagagatttgatttgcaaaggaagcccccaaaacgtgcctgttatccacacgaccctgtatgtctagggcaggccttgatggctgatcaacctgtcttgaagtgaatgagggagaatattttaacgtggaatgccaccttaaagcatgactttaaaaaatatcttgaggctgggcctgtaatccgagcactttgggaggccaaagtgggaggatctcttgagctcaggagttcaagcccagcctaggcaacatagcaagagctcgcctctacaaaaa

SEQ ID NO: 52441 - DNA, 2352 bp, Homo sapiens
accggtggtcagagtgaaacagaacagaacgggaggtttcacaatgtccttccatacaatctctggaatctatagataacaacagctgctaggtcaggggtcgaattttaactaccaggcttaggtcaggcaggcccaggcctggtttcgggtctggttccttggtttcgggtctggttccttggtttcaggtctggtttttaggcgccgggctacctgcctttagtttcgcttctctttccttttccgagtataaaacagtatgagagggtctctctcctccctcagtgccatcctcatccctgggtgggagttgtctggatccatagggttggagccacagataacagagccattaatctcggggtctcagcctctcttaacggaccttccaggcactgctgagaaaaccaggttaatggtttcctgcggcagcaatgagcagaagcagggccatctccagactccagagaagccaggagagggctggggtgataatggggaggaggataaaaaacagccacccaatgcgtgccttccctgtgccaggcccttgtcctgaaatgttatctcactccatcctcccaacagtcccttgggctaaattggtgatgctgcttgtttgagtgagcaaacagagggtgaatgaagtgacttgcgggcagctgggtagaggatgaggtcagcattggtgtaaaggactggagcttcagggttctcgggattcgagtcctggccctgctgcttgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtc

SEQ ID NO: 52442 - DNA, 1538 bp, Homo sapiens
ctgggttccagggacgctggggccggagctgctgccgccgtctacacggtcccctcatttgacgggttcgcctcctagcagcgcctgggcgagtgacatctgggccggaccagctggtgctgcgcggcgcagataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtc

SEQ ID NO: 52443 - DNA, 339 bp, Homo sapiens
tgcaagcgaggcacttgctaactcttggcctccctgaacataggaaaccgtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtc

SEQ ID NO: 52444 - DNA, 3121 bp, Homo sapiens
  misc_feature (3108)..(3108): n is a, c, g, or t
aaggacagaggaggggcccttcctgtcagctggctgggagcagaggtggctttgtcttttcggaagaactggttctgtggaatttgtgcttatttcccatcaaggatcaaggacctgctctggggctacctcagggccccacaggatgaggggctggttttcagatgagttttctgcttgcctgtcatctggatagtgtctaaaaatttgcaaactgccttcttgtcagtgtcttgctcattcttcatgacactcctgatatgtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcaaaaaggggtatgctccatgctttgagtcaccaatgaagcgggtgagggaagatgagagggggaggtgagagcttctgggaaggggcatttgagctgggttttgagggatgattatgagctctctggagaggagtgatattccatttatttagaaagcctttactgacaccttgtgctcaggcctgtgttggttctggggccctagaagaaccagtcctagccctggtccatacgggctcccaactgctggaagtacagactggcacagcaacatcagggttgtgacagagggaagcatggctggggggagggggtacacagacagtgcccatgacccagtccaaggagtcaggaaagagctctctgaggagggagcatctgagccagatgttgagggctgagtgggaacttggcaagcagaagtggggagcactttaatgcaacccaggtatgctccatgcatatccagctgggccagcctcgtgctgggctctgccctgggcagacaggcagagggccagagcagaggacacatggccttgcgtgtgtgaaagctgagaaaatgggagctgtgcttcagctaccctccagacaagggcaagagttagccagatgctccaggcagtgggaagccaatggagggattaagcggcggaagcttcttagaagaggcagggggcgaagtgcagtggctcatgcctgtaatctcagcaatttgggaggccaaggaaggaggaatgcttgagcccaagagttttagaccagcctgggcaacacagtaagaccctgtttctacaaaaaaatataaaaaatagcctggtgtggtggtgtctgactgtagtactaactactcaggaagctgaggtgctgagttcgagattacagtgagctaggagtgatccagtgcattccagcctgagcgacagagggagacactgtctctaaaaaaattaaaataaatcgggagcagtggctcacatctgtaatcccagcactttgggaggctgaagcaggtggatcacttgaggtcaggaatttgagaccagcctggccaacacagtgaaaccctgtctctaccgaaaatacaaaaattagctgggcatggtggctggtgcctgtaatcccagctactcgggaggctaaggcaagcgaattgcttgaacctgggaggcggaggttgcagtgagccgagatcacatcactgcattccagcctgggcgatggagcgagaacctgtctcataacccgggatactaacatattgttatttccccctctncctttctctctct

SEQ ID NO: 52445 - DNA, 3559 bp, Homo sapiens
  misc_feature (3546)..(3546): n is a, c, g, or t
accggtggtcagagtgaaacagaacagaacgggaggtttcacaatgtccttccatacaatctctggaatctatagataacaacagctgctaggtcaggggtcgaattttaactaccaggcttaggtcaggcaggcccaggcctggtttcgggtctggttccttggtttcgggtctggttccttggtttcaggtctggtttttaggcgccgggctacctgcctttagtttcgcttctctttccttttccgagtataaaacagtatgagagggtctctctcctccctcagtgccatcctcatccctgggtgggagttgtctggatccatagggttggagccacagataacagagccattaatctcggggtctcagcctctcttaacggaccttccaggcactgctgagaaaaccaggttaatggtttcctgcggcagcaatgagcagaagcagggccatctccagactccagagaagccaggagagggctggggtgataatggggaggaggataaaaaacagccacccaatgcgtgccttccctgtgccaggcccttgtcctgaaatgttatctcactccatcctcccaacagtcccttgggctaaattggtgatgctgcttgtttgagtgagcaaacagagggtgaatgaagtgacttgcgggcagctgggtagaggatgaggtcagcattggtgtaaaggactggagcttcagggttctcgggattcgagtcctggccctgctgcttgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcaaaaaggggtatgctccatgctttgagtcaccaatgaagcgggtgagggaagatgagagggggaggtgagagcttctgggaaggggcatttgagctgggttttgagggatgattatgagctctctggagaggagtgatattccatttatttagaaagcctttactgacaccttgtgctcaggcctgtgttggttctggggccctagaagaaccagtcctagccctggtccatacgggctcccaactgctggaagtacagactggcacagcaacatcagggttgtgacagagggaagcatggctggggggagggggtacacagacagtgcccatgacccagtccaaggagtcaggaaagagctctctgaggagggagcatctgagccagatgttgagggctgagtgggaacttggcaagcagaagtggggagcactttaatgcaacccaggtatgctccatgcatatccagctgggccagcctcgtgctgggctctgccctgggcagacaggcagagggccagagcagaggacacatggccttgcgtgtgtgaaagctgagaaaatgggagctgtgcttcagctaccctccagacaagggcaagagttagccagatgctccaggcagtgggaagccaatggagggattaagcggcggaagcttcttagaagaggcagggggcgaagtgcagtggctcatgcctgtaatctcagcaatttgggaggccaaggaaggaggaatgcttgagcccaagagttttagaccagcctgggcaacacagtaagaccctgtttctacaaaaaaatataaaaaatagcctggtgtggtggtgtctgactgtagtactaactactcaggaagctgaggtgctgagttcgagattacagtgagctaggagtgatccagtgcattccagcctgagcgacagagggagacactgtctctaaaaaaattaaaataaatcgggagcagtggctcacatctgtaatcccagcactttgggaggctgaagcaggtggatcacttgaggtcaggaatttgagaccagcctggccaacacagtgaaaccctgtctctaccgaaaatacaaaaattagctgggcatggtggctggtgcctgtaatcccagctactcgggaggctaaggcaagcgaattgcttgaacctgggaggcggaggttgcagtgagccgagatcacatcactgcattccagcctgggcgatggagcgagaacctgtctcataacccgggatactaacatattgttatttccccctctncctttctctctct

SEQ ID NO: 52446 - DNA, 1665 bp, Homo sapiens
ctgggttccagggacgctggggccggagctgctgccgccgtctacacggtcccctcatttgacgggttcgcctcctagcagcgcctgggcgagtgacatctgggccggaccagctggtgctgcgcggcgcagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtc

SEQ ID NO: 52447 - DNA, 2855 bp, Homo sapiens
  misc_feature (2842)..(2842): n is a, c, g, or t
taggctaggtacgggccgggtgttaatcggccgagggctgcttgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcaaaaaggggtatgctccatgctttgagtcaccaatgaagcgggtgagggaagatgagagggggaggtgagagcttctgggaaggggcatttgagctgggttttgagggatgattatgagctctctggagaggagtgatattccatttatttagaaagcctttactgacaccttgtgctcaggcctgtgttggttctggggccctagaagaaccagtcctagccctggtccatacgggctcccaactgctggaagtacagactggcacagcaacatcagggttgtgacagagggaagcatggctggggggagggggtacacagacagtgcccatgacccagtccaaggagtcaggaaagagctctctgaggagggagcatctgagccagatgttgagggctgagtgggaacttggcaagcagaagtggggagcactttaatgcaacccaggtatgctccatgcatatccagctgggccagcctcgtgctgggctctgccctgggcagacaggcagagggccagagcagaggacacatggccttgcgtgtgtgaaagctgagaaaatgggagctgtgcttcagctaccctccagacaagggcaagagttagccagatgctccaggcagtgggaagccaatggagggattaagcggcggaagcttcttagaagaggcagggggcgaagtgcagtggctcatgcctgtaatctcagcaatttgggaggccaaggaaggaggaatgcttgagcccaagagttttagaccagcctgggcaacacagtaagaccctgtttctacaaaaaaatataaaaaatagcctggtgtggtggtgtctgactgtagtactaactactcaggaagctgaggtgctgagttcgagattacagtgagctaggagtgatccagtgcattccagcctgagcgacagagggagacactgtctctaaaaaaattaaaataaatcgggagcagtggctcacatctgtaatcccagcactttgggaggctgaagcaggtggatcacttgaggtcaggaatttgagaccagcctggccaacacagtgaaaccctgtctctaccgaaaatacaaaaattagctgggcatggtggctggtgcctgtaatcccagctactcgggaggctaaggcaagcgaattgcttgaacctgggaggcggaggttgcagtgagccgagatcacatcactgcattccagcctgggcgatggagcgagaacctgtctcataacccgggatactaacatattgttatttccccctctncctttctctctct

SEQ ID NO: 52448 - DNA, 2450 bp, Homo sapiens
  misc_feature (2437)..(2437): n is a, c, g, or t
taggctaggtacgggccgggtgttaatcggccgagggctgcttgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcaaaaaggggtatgctccatgctttgagtcaccaatgaagcgggtgagggaagatgagagggggaggtgagagcttctgggaaggggcatttgagctgggttttgagggatgattatgagctctctggagaggagtgatattccatttatttagaaagcctttactgacaccttgtgctcaggcctgtgttggttctggggccctagaagaaccagtcctagccctggtccatacgggctcccaactgctggaagtacagactggcacagcaacatcagggttgtgacagagggaagcatggctggggggagggggtacacagacagtgcccatgacccagtccaaggagtcaggaaagagctctctgaggagggagcatctgagccagatgttgagggctgagtgggaacttggcaagcagaagtggggagcactttaatgcaacccaggtatgctccatgcatatccagctgggccagcctcgtgctgggctctgccctgggcagacaggcagagggccagagcagaggacacatggccttgcgtgtgtgaaagctgagaaaatgggagctgtgcttcagctaccctccagacaagggcaagagttagccagatgctccaggcagtgggaagccaatggagggattaagcggcggaagcttcttagaagaggcagggggcgaagtgcagtggctcatgcctgtaatctcagcaatttgggaggccaaggaaggaggaatgcttgagcccaagagttttagaccagcctgggcaacacagtaagaccctgtttctacaaaaaaatataaaaaatagcctggtgtggtggtgtctgactgtagtactaactactcaggaagctgaggtgctgagttcgagattacagtgagctaggagtgatccagtgcattccagcctgagcgacagagggagacactgtctctaaaaaaattaaaataaatcgggagcagtggctcacatctgtaatcccagcactttgggaggctgaagcaggtggatcacttgaggtcaggaatttgagaccagcctggccaacacagtgaaaccctgtctctaccgaaaatacaaaaattagctgggcatggtggctggtgcctgtaatcccagctactcgggaggctaaggcaagcgaattgcttgaacctgggaggcggaggttgcagtgagccgagatcacatcactgcattccagcctgggcgatggagcgagaacctgtctcataacccgggatactaacatattgttatttccccctctncctttctctctct

SEQ ID NO: 52449 - DNA, 2266 bp, Homo sapiens
accggtggtcagagtgaaacagaacagaacgggaggtttcacaatgtccttccatacaatctctggaatctatagataacaacagctgctaggtcaggggtcgaattttaactaccaggcttaggtcaggcaggcccaggcctggtttcgggtctggttccttggtttcgggtctggttccttggtttcaggtctggtttttaggcgccgggctacctgcctttagtttcgcttctctttccttttccgagtataaaacagtatgagagggtctctctcctccctcagtgccatcctcatccctgggtgggagttgtctggatccatagggttggagccacagataacagagccattaatctcggggtctcagcctctcttaacggaccttccaggcactgctgagaaaaccaggttaatggtttcctgcggcagcaatgagcagaagcagggccatctccagactccagagaagccaggagagggctggggtgataatggggaggaggataaaaaacagccacccaatgcgtgccttccctgtgccaggcccttgtcctgaaatgttatctcactccatcctcccaacagtcccttgggctaaattggtgatgctgcttgtttgagtgagcaaacagagggtgaatgaagtgacttgcgggcagctgggtagaggatgaggtcagcattggtgtaaaggactggagcttcagggttctcgggattcgagtcctggccctgctgcttgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtc

SEQ ID NO: 52450 - DNA, 3387 bp, Homo sapiens
aaggacagaggaggggcccttcctgtcagctggctgggagcagaggtggctttgtcttttcggaagaactggttctgtggaatttgtgcttatttcccatcaaggatcaaggacctgctctggggctacctcagggccccacaggatgaggggctggttttcagatgagttttctgcttgcctgtcatctggatagtgtctaaaaatttgcaaactgccttcttgtcagtgtcttgctcattcttcatgacactcctgatatgtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcaaaaaggggtatgctccatgctttgagtcaccaatgaagcgggtgagggaagatgagagggggaggtgagagcttctgggaaggggcatttgagctgggttttgagggatgattatgagctctctggagaggagtgatattccatttatttagaaagcctttactgacaccttgtgctcaggcctgtgttggttctggggccctagaagaaccagtcctagccctggtccatacgggctcccaactgctggaagtacagactggcacagcaacatcagggttgtgacagagggaagcatggctggggggagggggtacacagacagtgcccatgacccagtccaaggagtcaggaaagagctctctgaggagggagcatctgagccagatgttgagggctgagtgggaacttggcaagcagaagtggggagcactttaatgcaacccaggtatgctccatgcatatccagctgggccagcctcgtgctgggctctgccctgggcagacaggcagagggccagagcagaggacacatggccttgcgtgtgtgaaagctgagaaaatgggagctgtgcttcagctaccctccagacaagggcaagagttagccagatgctccaggcagtgggaagccaatggagggattaagcggcggaagcttcttagaagaggcagggggcgaagtgcagtggctcatgcctgtaatctcagcaatttgggaggccaaggaaggaggaatgcttgagcccaagagttttagaccagcctgggcaacacagtaagaccctgtttctacaaaaaaatataaaaaatagcctggtgtggtggtgtctgactgtagtactaactactcaggaagctgaggtgctgagttcgagattacagtgagctaggagtgatccagtgcattccagcctgagcgacagagggagacactgtctctaaaaaaattaaaataaatcgggagcagtggctcacatctgtaatcccagcactttgggaggctgaagcaggtggatcacttgaggtcaggaatttgagaccagcctggccaacacagtgaaaccctgtctctaccgaaaatacaaaaattagctgggcatggtggctggtgcctgtaatcccagctactcgggaggctaaggcaagcgaattgcttgaacctgggaggcggaggttgcagtgagccgagatcacatcactgcattccagcctgggcgatggagcgagaacctgtctcaaaaaaaacccaaaaaaaacaaaattaaataataactaagaaaaaaaaaaaaaaaaaaaactcgagacctagttctctatccagcgtaaccgcactgtctgctatgacctcagcccgcctgccctggccacccactatatgccctatggcatggctctcactgtcctcggcttcctgctgccctttgctgccctgctggcctgctactgtctcctggcctgccgcctgtgccgccaggatggcccggcagagcctgtggcccaggagcggcgtggcaagcggcccgcatgccgtggtggtggctgctgccttgccatc

SEQ ID NO: 52451 - DNA, 2991 bp, Homo sapiens
  misc_feature (2978)..(2978): n is a, c, g, or t
ctgggttccagggacgctggggccggagctgctgccgccgtctacacggtcccctcatttgacgggttcgcctcctagcagcgcctgggcgagtgacatctgggccggaccagctggtgctgcgcggcgcaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcaaaaaggggtatgctccatgctttgagtcaccaatgaagcgggtgagggaagatgagagggggaggtgagagcttctgggaaggggcatttgagctgggttttgagggatgattatgagctctctggagaggagtgatattccatttatttagaaagcctttactgacaccttgtgctcaggcctgtgttggttctggggccctagaagaaccagtcctagccctggtccatacgggctcccaactgctggaagtacagactggcacagcaacatcagggttgtgacagagggaagcatggctggggggagggggtacacagacagtgcccatgacccagtccaaggagtcaggaaagagctctctgaggagggagcatctgagccagatgttgagggctgagtgggaacttggcaagcagaagtggggagcactttaatgcaacccaggtatgctccatgcatatccagctgggccagcctcgtgctgggctctgccctgggcagacaggcagagggccagagcagaggacacatggccttgcgtgtgtgaaagctgagaaaatgggagctgtgcttcagctaccctccagacaagggcaagagttagccagatgctccaggcagtgggaagccaatggagggattaagcggcggaagcttcttagaagaggcagggggcgaagtgcagtggctcatgcctgtaatctcagcaatttgggaggccaaggaaggaggaatgcttgagcccaagagttttagaccagcctgggcaacacagtaagaccctgtttctacaaaaaaatataaaaaatagcctggtgtggtggtgtctgactgtagtactaactactcaggaagctgaggtgctgagttcgagattacagtgagctaggagtgatccagtgcattccagcctgagcgacagagggagacactgtctctaaaaaaattaaaataaatcgggagcagtggctcacatctgtaatcccagcactttgggaggctgaagcaggtggatcacttgaggtcaggaatttgagaccagcctggccaacacagtgaaaccctgtctctaccgaaaatacaaaaattagctgggcatggtggctggtgcctgtaatcccagctactcgggaggctaaggcaagcgaattgcttgaacctgggaggcggaggttgcagtgagccgagatcacatcactgcattccagcctgggcgatggagcgagaacctgtctcataacccgggatactaacatattgttatttccccctctncctttctctctct

SEQ ID NO: 52452 - DNA, 196 bp, Homo sapiens
cagcagacaaacaagaatgttgaaatagctacaataaatatattcaatatattcaagtaattaaaacaaaaatcaacataagtagagaaatggaaaatataaagagccaaatggaacttataaagatgaaatataaagtatatttaatgaatttcacttatataaattacagacaagttagatactgcagaagaaa

SEQ ID NO: 52453 - DNA, 1113 bp, Homo sapiens
atttcctttccacctatttttgtgtcacaatatcttctttataaatggatcatattccttcacttatctctttcagcatcctaaacttcttttaaactttttgtatgtctattatacaaaatcaatttcatctggaataaattcatgttgtaattgttgattttattaattaccattctgagaattagaatttgccttgttttttggaattctgtattatatgcttcttagtgggagacttaatgttttgtttcctttttttctcccattatgatcactcttccaaaccagaacctgctcttaaaatgactttgcgggttcaggcttcatattgacttaatattgtgggaaactttgttaagttattattgtaaggcaacgtttttgtctccccatatcaagtccacaactttttagaaaactttactgtagataccaggttggcagattttcccagcatcctgttataaggagggacttgagcaagaaatcttgctctggctttcatggaacacatttgaaacaattcattgtccttaacagcctaaacacccagataccagagttcactaccttgaatgtctattccattcctgatcttgttttcaagtctagttatatatatattccacatttttctttttatactttattacttatgtgtgtttggagcaggaatggaagggctgtggtgatgcttgaacttaccattctattttgcctgaaagtcttaattaaaaaaatattttacaagctcaatgctgtatcataatgagtggattttagagtgagaacacagcaaatgctagaaacctcagaatgactcttaatgctaacttattaggactgactcatgttattttagcatttgaaatatctgaggagttagttacctttctttctatctcgtggtatctgaatcacccaggtcctggaccttattgtcctatttacctcattcctattctaaataataatgcacttatcacatactgagtaagcttactatgtgaaggtagataggtaaatatttcagataggttatttaatttttcacaaaaatcctgagattacagattgagtatctcttacccaaaatgaagtgtttaagat

SEQ ID NO: 52454 - DNA, 161 bp, Homo sapiens
tcaacttttacttagaaaccatttggtatggaggattatatgtttatgcaggcaagattccttttaaagaggagatgaagatgataaaagttgtttctccaatttttaatgaaacttgcttaataattcccaaatgttggcaggaaccttggaaccatttt

SEQ ID NO: 52455 - DNA, 278 bp, Homo sapiens
agcagtccttcagaggccctgagtttgcccatagttctatagatgtggaaggaccctttgcaaatgttaatagaggtaatacatgctgtttgtcaattacttgcctagtggtagtgactgttcatgttttataatcttgtgctggaactattaataccattagcaaagcatgaaatttgtgttcctagtgctttccattgacaaaccatcatacagtggggctgtaactaacaaggaaggatgaggttgcataattcatatggtgatcagatggtact

SEQ ID NO: 52456 - DNA, 822 bp, Homo sapiens
  misc_feature (164)..(164): n is a, c, g, or t
  misc_feature (346)..(346): n is a, c, g, or t
  misc_feature (447)..(447): n is a, c, g, or t
  misc_feature (573)..(573): n is a, c, g, or t
ggagaagtctggaatgcacttaatagctggtttttacaccttgatttcgaggtggaaagaaatgatcatgaatctctaataaatttaaatctcttaaaccagtaggtgcttaatatttttgattgattaatgcccatttaaatctcatgggttctattaaaaanatatatatatagggccccaatccattgccatcaaatgcccttggacttttccaaggtatattatggggttttatgcaaaattccaagctaccatgtaactttttttaaccatttaacaaggagggggaactgtttcctaccttctttacatgtgtgcattgtgtggtccagaaatgccaaanctttttaaagatggtgcaactttgagtcctggcttgactatacaggccttgaacttcatggcatatcaacttgccatatctgcaggagagctgttctatangaaatagctcagagttgcaaatatcacatgtgaatgatacggtaacttttaagaaatgtctgtattgtatttgaagactgtttgccatatcaactttgccatatctgcaggagagctgttctatangaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagtttttggttataatattgtaatctcagttcaaaagttaactgcaaaatataaaaccaatgatttctatatagtaaattgaactgtaaaggtaaaaa

SEQ ID NO: 52457 - DNA, 696 bp, Homo sapiens
  misc_feature (164)..(164): n is a, c, g, or t
  misc_feature (346)..(346): n is a, c, g, or t
  misc_feature (447)..(447): n is a, c, g, or t
ggagaagtctggaatgcacttaatagctggtttttacaccttgatttcgaggtggaaagaaatgatcatgaatctctaataaatttaaatctcttaaaccagtaggtgcttaatatttttgattgattaatgcccatttaaatctcatgggttctattaaaaanatatatatatagggccccaatccattgccatcaaatgcccttggacttttccaaggtatattatggggttttatgcaaaattccaagctaccatgtaactttttttaaccatttaacaaggagggggaactgtttcctaccttctttacatgtgtgcattgtgtggtccagaaatgccaaanctttttaaagatggtgcaactttgagtcctggcttgactatacaggccttgaacttcatggcatatcaacttgccatatctgcaggagagctgttctatangaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagtttttggttataatattgtaatctcagttcaaaagttaactgcaaaatataaaaccaatgatttctatatagtaaattgaactgtaaaggtaaaaa

SEQ ID NO: 52458 - DNA, 281 bp, Homo sapiens
taccaagggtcctgccctgcctagaaccttcctatcatagggctcagcaaactctcttacctgggctttgcaatgtctccactctgacctctctctccctgctcccacctgcaggtccacactctgctgaagccccacaccactgccactctggaacaggcacctccaccagccaccctgtccctccctgtcatttattctcccagctaaagcatgaatctataaaaggaagctctcttctcacaggatccaactcgtcctccaccctcacacaacactcc

SEQ ID NO: 52459 - DNA, 298 bp, Homo sapiens
tagaatctgccctcttatcagccacccacatccaccacctccaccaccccagtccaacctcatatcatcctgtggctgagtcactgcaacaacattcaaactaatttcattcacactttgccctttgctatgatgattatcttaaaacatatattagatcaagtcgctcctgtgcaagccctcaacaatttcccctatttctcaggatcgaaataaaattccttgtcataggctttacaagatcttatatgatctggccaccccagttacttctctgtcttcctttcctatttccttg

SEQ ID NO: 52460 - DNA, 575 bp, Homo sapiens
tgggagtgggtgggcccagggttggggtgaatgccggggacctgccaggcacataggagctagcccacaaatgttcccagatgagggcctggttggagcacagagggtttgtcatgtctgcctgtcccggcagcccctttacctcccagtgaggggcttgggtcaggcactgttgtccccattttacagatgagaacgctgaggctgagattcccagatcaacctgggtctctctctgccccagcccagcctggctgatgctgcccttctgtccccagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagaaaaaaaaaat

SEQ ID NO: 52461 - DNA, 977 bp, Homo sapiens
cagcgacatctagtggctgaatgtattttaaacactcggcttgctgagggcgtgagtcggagcgctgctccccaggactcagctctcattcgcctctgcgcttcggcggggacggggagccgggccgagtcagagtgaacacacactccctgcgcgtgcaactgagtcgagcgtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagatctgcaagctgctccacccactgaggacaaatagaaacaggtcccctgggagtgctgagtcacggggctcccttcagccctgttccagcagcagaaggccgggcgattttaccctgtgccctgtgaaaaatctttgtgtctgagggagcagaggaaaaactcttgtcagatgggaaaaatgctcatgacataatgtgacattaaaaggtgggaaacaagaggatatagcagtatgagtcagacaccttggaacagtaatcatgataaatgcctttacatgtgggagtctctggccggagctgacatttgcgcagaggcttagtgtggagggaagagccggggaagaacatcaggcacagggaacagtgcctgccaggctgaggagagcgtgagcttagcatgctagagaagccaggacggtggtgtggccaggacggcagtgtggccagtaagtggtaagcc

SEQ ID NO: 52462 - DNA, 821 bp, Homo sapiens
ctgcgccggccgcatgcaattcacgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagtttgtgcctggtcgcctcctcagatctgcaagctgctccacccactgaggacaaatagaaacaggtcccctgggagtgctgagtcacggggctcccttcagccctgttccagcagcagaaggccgggcgattttaccctgtgccctgtgaaaaatctttgtgtctgagggagcagaggaaaaactcttgtcagatgggaaaaatgctcatgacataatgtgacattaaaaggtgggaaacaagaggatat

SEQ ID NO: 52463 - DNA, 882 bp, Homo sapiens
ctgcgccggccgcatgcaattcacgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagtgacccgtgtccgttctcagggctttgtcaccctcctcttcaacgtggtgaccaaggacatgaggaaactgggctatgacactgggccttctgatacacagggtgtgttggggcccagcccaccccagagcttcccgaagtcagccgctgcccatcggcctgaggggcagcctggtggccagagctgggggcacacagaatagttttgtataataaagtctcattttcagagaaaaaaaaaat

SEQ ID NO: 52464 - DNA, 936 bp, Homo sapiens
ctgcgccggccgcatgcaattcacgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagaaaaaaaaaat

SEQ ID NO: 52465 - DNA, 798 bp, Homo sapiens
ctgcgccggccgcatgcaattcacgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagatctgcaagctgctccacccactgaggacaaatagaaacaggtcccctgggagtgctgagtcacggggctcccttcagccctgttccagcagcagaaggccgggcgattttaccctgtgccctgtgaaaaatctttgtgtctgagggagcagaggaaaaactcttgtcagatgggaaaaatgctcatgacataatgtgacattaaaaggtgggaaacaagaggatat

SEQ ID NO: 52466 - DNA, 879 bp, Homo sapiens
cagcgacatctagtggctgaatgtattttaaacactcggcttgctgagggcgtgagtcggagcgctgctccccaggactcagctctcattcgcctctgcgcttcggcggggacggggagccgggccgagtcagagtgaacacacactccctgcgcgtgcaactgagtcgagcgtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagaaaaaaaaaat

SEQ ID NO: 52467 - DNA, 1025 bp, Homo sapiens
ctgcgccggccgcatgcaattcacgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagatgagaacgctgaggctgagattcccagatcaacctgggtctctctctgccccagcccagcctggctgatgctgcccttctgtccccagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagaaaaaaaaaat

SEQ ID NO: 52468 - DNA, 268 bp, Homo sapiens
aaaatacaaaagttagccaggcacagtggtgcatgtctgtaatcccagctactcaggaggctgaggcagaagagtcgcttgaacctgggaggcagaggttgcagtgagccgagatcgtgccattacactccagcctggatgacggagcaagactctgtcttaaaaataaataaataaaataaactaaaacagaaaaagaaatagatacttcaacttctggctgcggggaacacccatattaatgcctgttctataaggtcacaagcaa

SEQ ID NO: 52469 - DNA, 404 bp, Homo sapiens
cagagaacctttgtgtcccctgggtgttctagcccagtatatctcaaactttgctgcactgaggaccttgttgaaatgcaggttctcatctggcaggctcagtcggccagcaaatgtgcattgctttaggaagctcaccctgagtagcaagtttcagtgaggaccaggcagccctgcctgccctctcagctgggcttaaccctggctctcgcccgccagagttcctcccctcaaaataggagctattttcaaaacgcctcttggaaaaaaggccctgttttaaaattggggtgtttaggattggccatctgctcaccatggggttttaagacctttgcccaaacccccgcaaccaacttagaactgacattttcactcttgaagggcccactccacaccatgtt

SEQ ID NO: 52470 - DNA, 1248 bp, Homo sapiens
tctcaggctgacagagatttgaattctccctgagatggagtgccccgagggaggggtgggctgccatatttgatgttttggcaacttagccattccaacctttgggctttaaggagtcccagctgacttagggtggatatagcccaccagcacagcacagctgctgtacaaaagcatagccagactgcttctttaagcaggtcccggattcattcctcctcactgtttgggacttcccaactggggcctccagccacccccactggtgttctcctgctgacagtgatttcagttttttcttggctggagctccctgatggaggggcaggccatcatgtttgctgtttttgcaacttaaccacttcaaccttcagtctttggagtgtccaaggagaccaggggctgatgtggaccctcagcatagcacagatgctctataaaaatgtggtcagactgctttttaagcactttcccaatgtcattccgcctcactgggcaaaaccccctaactggggtctccagctacctcctacaggtgtgtttgggccagcaacaagttcattcatacctccctagggcaaagcttccaaagggagcagtaggctgccaacttttctgtttcacagccttcactgatgataactccaggtactggaaaatctgaggctactagagactgaagtgggccctgggcatactgcagcagccctatggaaaagtggccagactgttacctgggttcccattcctgtatcttctcactaggcaagtcttgcaggcctgggcctctacctaacccccctgccagagctgtcgagccagtagcaactcagccactccctggacagagcctccaggggcaactgaaagcctctctgccactgcttctgcagtggaactgtccttgctaccctcagactgatgaaggagctaacacccttatctacaccttcaacaagctttaattgaccaaagcccatctcccacgggttttacacactccccactgctcataacagacagggaacccctggattggcccccacagcatgaattctccatcctgcttgctgattgcaataaacagttgctgacctgtattctccgggggtagaaccctgaggagacaaacaaaagacccttggctacaaccactactaatgtcccttcctcttcttccccaaagttagggaagaaatataaacactgagattgccccagagctgcagtgggcagcctaggagtgcc

SEQ ID NO: 52471 - DNA, 572 bp, Homo sapiens
tggcagctggcgaagcttctcgtgctgctcctgaagcctgtcctcctgcttccgaagcctgggttcccattcctgtatcttctcactaggcaagtcttgcaggcctgggcctctacctaacccccctgccagagctgtcgagccagtagcaactcagccactccctggacagagcctccaggggcaactgaaagcctctctgccactgcttctgcagtggaactgtccttgctaccctcagactgatgaaggagctaacacccttatctacaccttcaacaagctttaattgaccaaagcccatctcccacgggttttacacactccccactgctcataacagacagggaacccctggattggcccccacagcatgaattctccatcctgcttgctgattgcaataaacagttgctgacctgtattctccgggggtagaaccctgaggagacaaacaaaagacccttggctacaaccactactaatgtcccttcctcttcttccccaaagttagggaagaaatataaacactgagattgccccagagctgcagtgggcagcctaggagtgcc

SEQ ID NO: 52472 - DNA, 625 bp, Homo sapiens
cattttcaactttcaagttttattcgttcattatttttgcaacacctgtttggtgcaagtcactgtgctgggtactataggaaatatatttagctttttgcttctcagattgtagagacagaccacacatgcataatcccaattcgaggcagcatatgccacatgtcacagaagaggctgtcacaggcagtagccactgttgcatagctacttcaaagccattcccagcttgttccacctgccaacacaacgcagctctgtcctggtgtgggacacccatgtgcattggaggggctgggcttcactaccagggtgaaccttcccctaagccaatcaaggtaattccagttgtttcgccagggcctggttaaggaaccagcatgtgatgtaattatggaaatgagaggtgagccctgggcattactgcgtgagcacattgtgcttgtgcttgtgcttgtgcctggtgcttgaggttgctgcagccgtcttgtgaccagaatgggacaaacacgaggacaaaagctaccgctcaatagcaaggcaacacagaaagctgaaaagagcatgggccccgatagagtgttgagcccctgaattaaccaaccttgacaccaaaccttgctct

SEQ ID NO: 52473 - DNA, 361 bp, Homo sapiens
cctgattaaaggcaagatcaaatgagctcacgggcatttccactagtgaccagtgacctcagagcaaatcttccttaattcccaaagcataatttgaatttttatgagaagtgaaaggaggaggtcagttattttggacaaatattatttcaaactcatagaacagatgtttcaagtgattccctacttttctgcctgcttcccttcctaaaactgtgcttccccttttgtaaatcttagtgtgcagcctatgattgcaagctgagctgtgggccttgaaagactcgtggtgaaagtgaatctgaacagcaaagctgctgcaattcaggagcaggggtaaagaaggaagggccagtagcat

SEQ ID NO: 52474 - DNA, 324 bp, Homo sapiens
gcgcaggtttggcagggagcagggagacatgctggcaggcatgcatggtggctttgatttgaggagctgttggtgggaatgaaaagcctaataagcacgtgggctttggatctgccaccccccagctctgccaacagctgtgagaccttgggcgggttgttcagcagccctgtacctcagtttccccatcagtaaaatgtgcatatggttgtgaggactgaattagctagtatctgatctaagttgtccagtacgggagactggccacgtgcaactgtgaagtacttcaaaaggtggcttttctgaactgagatgtgcttttga

SEQ ID NO: 52475 - DNA, 303 bp, Homo sapiens
ctgcatatccaatcccactatccattccccttcctgtgccttcttttcccccaaagcccgttatcatcacccaaccacctgtatatttcaatcctttctcttgtttatctattcctatgaaggcaaggatttggggctattttgtctcctgctgtgtttgctaggcctagcaccgtgattggcacataaagggtactgaatacttactggggaataaatgattggatgtttgcatgcccgggtctccggccccctctgggatgctggcctctgtcccgcatcctcaaggtctgcccacacctg

SEQ ID NO: 52476 - DNA, 901 bp, Homo sapiens
ttcttccagccagcattcatcctttaatgttcgtgcccgtctccttagtgcttgatagaaaggatgcacttcttatgttagcaatgcttgtggagcctttgtggtcattctcagacatgcacagagtggggaaaaacattgagtcacctggaatccacgttcagctgaggttgaaccagcaatcctggaatcagggcactacgggtaaccacattctcactttacaaatgataactcacacaccccatggaagatccgggaagtcttctgatgcccctgctttccaagacaatatgatgcttctctacattccatggactatgacaagtatatcagtcgtcgaagtgggtggtttaatggcatgattagctccattttctcttcctgcagcatagcaaagtgcataaagcttgagctctgtgtccagcagatctttattagaattccagtccccccacagttacatatgctctctccctgacagttttcacagatgaatcatccagactccatttcctattagagctggaccctccacttggacttttgacacttagacccctctagcccacacagggacatcagtgcaataattctcccctttctacagcatcattaaattttgcctctctcctggatcatcccattcacatattcatatgctgctatttctcccatctaaaactgaccaggcactgtggctcatgtctataatcctagcactttgggaggccaaggctggcagatcacttgaggctaggagtttgagaccagcctggccaacatgacaaaaccccatctctactaaaaatacaaaaattagcagggtgtgctgcactccagcttgggcgacagagcaagacactgtctcaaaataaataaataattaattaaaaataaa

SEQ ID NO: 52477 - DNA, 409 bp, Homo sapiens
tttattaaacacctactagataccagacatttgctgactcttctattttcttctcttcttcagtgacagcttcattgttctggttgagatttaaacattaataaaatgaaattgcaaagccagaacttaatattacaaaatatgttctaagtagagcaaaccacattgtttagaaatctgggccaaatggattaacatctatctcaggagctgagaaacttgtatggctttatgctgtggtctaagatctcctctgaatactcaacatccttaagtccctgtatcagtttcttagggttgccacacaaatcaccacacactgggtggcttaaagcgacaggtatgtattttctcacagtgctggaggccagaagtctgaagtcaaagtgtcagcagggctctctgaggg

SEQ ID NO: 52478 - DNA, 1356 bp, Homo sapiens
caaacatttgaggctatttttacatgccattaatctaaatatgataaggatgtgttataggacacaaggaaaacttccttcgcctgaaataaatgccttccttgctaattccttaattttataccggagaaaaaccaaagcaaaagacagaaaaatacatttcctctgttaagttcctgataaattagcattttaaaagaaaacgaatataaccatagaattaattcatcaactttacagagctgtgaatatccattatggcccaaattatcctttcatttccattaagacacatgggcactgaagggaacctatgttcaaaatcttaccctctttgcctcagcctgccttggaagataaaatatgaaaggatctttagccatgaatgctttaaaaaatttaggaagtcgaagcatgaggcagacattttcttcagattgccttttataaatagaaatgatgaaatttaaaaataattaccagttgtgaatataatatttaagcttagatcttcagattgcactttttcgttttgcaaactgcaggaaaaagtgtcattaatataaacagccttagatgaaatagtgactcataaatacgtataattttctgtacgtgtccttgtttgtaccatgatcttagacaaaagatgaaatgcccagttaaggttatgactgaaaagagcttacacatcttttttttgaaaactcttgacttctcgtcgctttctgcttagatgtgcagttttggaaaacagaactgaagttttggctttgtgtctttactcacatggttatattgctcaacctgatctacagaaattattttgtcaaaagtagctttaagacctttcatttctgtacattttgatacttattttaaagcatcaagcagtgattaggattaggagcaatgttgacttcttttcaagttatatctcttacatgtgtcatgccctgtctggatttttaaagggaaattggctctgtccgtttatttataccacctcaattttgttccagtaagtaacagtagaccttctattgtatgcctttgggcaatatatttttttaaaatgcagccaaatgcagtggctcctgcctgtgatcccggcacttcaggaggctggaggatcacttgagcccaggagttcaagatcagcctgggcaacatagcaagaccccatctctacaaaaaatttttaaaattagctgggtgtggtgacacatgtctctagtcccaactactcaggaggctaaggcaggagactcgcttgagcccaggaatacaaggcttcagtgagccataattgaaaccactgcactgcagtcaggcaacagagcaagacctagtttc

SEQ ID NO: 52479 - DNA, 470 bp, Homo sapiens
aagtataccctcacttagcttgcagacccaaggcactccagcccctttcaagaagcttgcactttctgatattttctccatcactcttgcctcctgtggtagaggagctttgggctactccttaacaaatcattcatggatcggcagcaaatctgcaacatatggaaatatttgccaatttttgtcctcagctttgggtctcagccaaaatggagatttaggaaagtctcatttagcatcctctagcctgcttttggctgttttgttttgtttttgtgtttgttttttagagacagggtcttactctgttgccagactggaatgcggtggtgtgaccatagctcactgcagcctcaaactcctgggctcatgcaatcctcctgcctcagccttctgagtagctaggcctgtagtctcagagggaactgtcttcaataaagttggcactgtccacatacactccttaagtt

SEQ ID NO: 52480 - DNA, 302 bp, Homo sapiens
ctagcatacatcgtgtgctattccttgggcacagaaaaataagaatagatccggtcatgtaggcaggggaagaaacccaaagaagacgagacctcttctgccatgaacctagactgccaagaatgggactgggttttcacagtgctttggtggctttaaatctacattcgatagtttataatacattttcttaaagccaacctaaatatataaatttccctttcctcatcgattatttaattttgtatttcatttctgatagacagaagtgactatattttgttttcagttgcattctttat

SEQ ID NO: 52481 - DNA, 522 bp, Homo sapiens
gtgatcctcctgccttggcctcccaaagtgctaggattacaggcgtgagccaccatgcccagcctggtgtttatctttaaagtgggcacagccacaggagttcacctgactcctggtctgagagtcacgagatcgttcaagatagtgaggccctcttttccaaaacgaggaccaaaaatcaattgacagtgttggtcaagatggtagaaaccttaaaatgatagaaatctcaactctgaaataaaaactttatttgtatatttatttaccactattttgacatagggctaaggtctttttctttgagctgatttctggttttgttttcttaaagtggcataagaattcaaagacattttgaggaaggctgagtgcagaaatctctctttttaaatgacttctcctttcttttaacttgcactgttgtctagccctcacttattttgtcaattctttttagctgtttgtctttgaatcttcataaagccatagcttttctcataagaagcagcactttctttg

SEQ ID NO: 52482 - DNA, 474 bp, Homo sapiens
ctccgtcgcccaggctggagtgtggtggcacgatcttggctcattgcaagctccacctcccgggtttaagcaattctcctgcctccacctcccgagtagctgggattacaggcatgcaccaccatgcccagcaaatttttttttttgtatttttagtagaaaccttaaaatgatagaaatctcaactctgaaataaaaactttatttgtatatttatttaccactattttgacatagggctaaggtctttttctttgagctgatttctggttttgttttcttaaagtggcataagaattcaaagacattttgaggaaggctgagtgcagaaatctctctttttaaatgacttctcctttcttttaacttgcactgttgtctagccctcacttattttgtcaattctttttagctgtttgtctttgaatcttcataaagccatagcttttctcataagaagcagcactttctttg

SEQ ID NO: 52483 - DNA, 317 bp, Homo sapiens
ctgatggcgcagccagacccgccccgtgtgttgcagcccgtgtaatacccttctctccctacccacagttggggtcatcttctataagcgggtcatgaaataggcgagctagctctgtgcactcttttcttcctttctggaaaactagttctgaaagcatcttttttgttgctgttgtaggttatgatttaattctaccttattggtgtgaccaggaacagggcaagagtccacctctacaatcccataggaagaacagtcaggagaattatatacatctacagcgggcacaggacttaggccagatcttcctggaa

SEQ ID NO: 52484 - DNA, 395 bp, Homo sapiens
tcacggggacaccaggccctgggatagggctgggtcagaaagcctgctcttcccactcacttcccttcctctgtctctgggaacagatcagggctgcgatggtctgggttctctccccagccacacaggagggtgctgggactggggctccttctgctcctccacttggcagctctgtgacccaggccaggggcttcctgtcccttcctccctggctgctccgtgcagcacaagctgcatgtatgtgcctgggccagggccccaagaagcccctccatggagtgtggagcctgggcctggccttgccgagtccccttcctttgcctcggctcagcccctcggaacctggtgggggcggggtgggaatcctagccttctaccttccctgctcccgt

SEQ ID NO: 52485 - DNA, 290 bp, Homo sapiens
agcaaagcagaatttaacatagttttaacataccgttaattcacagagtatataatttaggcttccaaagtgctgcatttactttcgagcctctaggacactactgtcctgcctctgtaatatggggagaaataaagtttatttttatgtatttattttattttattttattttgagatggggtaccgctctgtcatctaggttggtgtgcagtggagtggcatactgttaattcacagagtatataatttaggtttccaaagaggggtacatttacttttgaggtttct

SEQ ID NO: 52486 - DNA, 1098 bp, Homo sapiens
ccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtg

SEQ ID NO: 52487 - DNA, 2094 bp, Homo sapiens
tgaatatgtaaaaatgaaagaaaaggccaactgtattgaagatacaaaatagagttggtagcggtatatagaagaaaaatcaagaggcttctgtgtagaaaaccaatttgtaatttaaggatcggggaccaaaaatttttaaagactaaatgtgttcacattactatagatatgtctataaggtgaagattcttttcttaggtatacaaatgtgatgttgtatataaatgggcttcccacccacaaatgcttattagcctaaaatggcctgaaagctctagtaattaaattatttctctgcgtcctaattttttgtctttgaaacagattatttagaaaatcatgtacttcgcttaagtttctaacttttacttgctttttccagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggaggtgcttatcttggctttcgagtctgagtttaaaactacacattttgacatagtgtttattagcagccatctaaaaaggctctaatgtatatttaactaaaattactagctttgggaattaaactgtttaacaaataaaaaaaaaaaaaaaaaaaaaaaaaaaaaaaaaaaaaaacaaaaaaaaaacaaaaaaaaaaaaaaaataaaaaaaaaaaaaaaagggaaaaaaaaaaaaaaaaaaaaaaaaaaaatctttggggcccctttggcccaatctttttttaatttgggaaagttttttcttggcccccaaattggggcttatttggccaattgccctttaggggggggggtttaaaattcaagggcgcgggttttaaagggggaggtgggg

SEQ ID NO: 52488 - DNA, 2632 bp, Homo sapiens
agcattagtttttgttttttatctgacaggtagctatggatattctgagggagaagccaggattaatacacattttttttttaagttgctgaattgtagtggctctcctttctagcatttttgtcactattgagccctcttagtttatgctagacgtgtttttcttattggttgatattttaaattattaaagccatcttctgaataagctttattcgcactttgtacctagtttctccatcagaaggatctattgctataccattgtatacattttctcattggtcttcgggttactttcagagtgtaaagactccttatgccacaaaattaagcttagatttcccccaaatcaaatactataaatcagattccttagtctagccacaattgacatatcttggagtggataaatctttgttgctggcattgttctgtgcatcataacttgtttagtggcatgtcatcactgtcttctactctctagatgccattagtatactcttcacagttaggacaaccaaaagtgtctccagatattgccaaatgtctcctgatgggcaaagtctatcccagttgcgaaccattattgtaaattaaacttggtttcaaatttgagctttattccttagctctgggaacttgggcaagttacttcccttcgagcctcaatgtcctcatttgtaaaatgacattaatacctacttttagctgtgggaattgagtaccatgatttatacaaagcagtttgtatggtgctggttacatgagagttcagatggtaactagttagtaaaaaatctctagtgtgcttgttgattttattttattttagtatttcttaaagatcaaatttaacatcaatcctaaactttatttagctttttctggcgtgtaaactaacatactaagttgtgtgactataattcatttagtgactcatttttagctatttttataacacattgtgctatggggggttttggaacttgctggaagctacatcagaaactgccatagttaattgccatttcaagaatgttgtaaataactcaggtggccgtttaattctcaatgtaaatataattaactagacatctttcctatatttgtgtctcagttttaaagctatttctggatgcttgagtcttaccgtaattgataacaaaaagaggttattgagaatatctatgatttacagagtaagttattctagacctcaagagtgaaatgtaggggaggagacatttgtgtgttaaactaatggaaatgctcatttaatagatattcactgaaagtattagttttggtttattgtagaaaagttgaggttttatggagatttttgtaaaaaatggtttatttcctaaataaatatctctttttcttttttctcccagaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggaggtgcttatcttggctttcgagtctgagtttaaaactacacattttgacatagtgtttattagcagccatctaaaaaggctctaatgtatatttaactaaaattactagctttgggaattaaactgtttaacaaataaaaaaaaaaaaaaaaaaaaaaaaaaaaaaaaaaaaaaacaaaaaaaaaacaaaaaaaaaaaaaaaataaaaaaaaaaaaaaaagggaaaaaaaaaaaaaaaaaaaaaaaaaaaatctttggggcccctttggcccaatctttttttaatttgggaaagttttttcttggcccccaaattggggcttatttggccaattgccctttaggggggggggtttaaaattcaagggcgcgggttttaaagggggaggtgggg

SEQ ID NO: 52489 - DNA, 2040 bp, Homo sapiens
ccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggaggtgcttatcttggctttcgagtctgagtttaaaactacacattttgacatagtgtttattagcagccatctaaaaaggctctaatgtatatttaactaaaattactagctttgggaattaaactgtttaacaaataaaaaaaaaaaaaaaaaaaaaaaaaaaaaaaaaaaaaaacaaaaaaaaaacaaaaaaaaaaaaaaaataaaaaaaaaaaaaaaagggaaaaaaaaaaaaaaaaaaaaaaaaaaaatctttggggcccctttggcccaatctttttttaatttgggaaagttttttcttggcccccaaattggggcttatttggccaattgccctttaggggggggggtttaaaattcaagggcgcgggttttaaagggggaggtgggg

SEQ ID NO: 52490 - DNA, 462 bp, Homo sapiens
ctgcagctcagtagtgcctctcgtacctgctccagaccctaagtaaatcacaagagtgcttcatttcaaatatgaatgaatccttgatgggaccaactaaccaacccaagccccacacgaaggaacaggagaagggtctgccgcagctaaggggtacgataggtataaacaaagcttgtaacctgacctcttgcaaatcaacagcacagtgcatggctaaagatagacttgctatccccaaacagaaatacacacaacccagaaaacctcactaagtgataacaatttcttgtaccctaaataactgtttacatttggatctcatttggtcattcttctaacccagggaggaaagattccaacagaacttgctgctctagtgtgtttattgaagatcgccttgttctggttctggttctggtttttgttttggttttgttgagacaagagcaagtctcactc

SEQ ID NO: 52491 - DNA, 734 bp, Homo sapiens
actagtgacttaagaccaggaggagggaagcaggggaggtttgtttttgattttaagggtaagaatctagttccgaacttcgtgactcccggaacactcctgaattgagtctgatacatttcataaatcaatcaagcccttatctagataactcaccatttcatttctgtatcaaattaagtagccctgggtcttttgctatatatttatatcttagaagctaatccaaaggacaaaaattcctctctgcacattactgcaagatttcagctttgctattacatcagaaagcagtaagctcaccaggacaaaaaccacagaaggccctgaaaagacttgcccccaacatacactggccattctaacccgcaaagcggaggctttcttttccttaagggtctgttctccagaaattcccttattcactgcctgcccagttcacactgtgtataccccaccctcaggagtataaacctgacaaatgcttttgagccaaaccagacagagtcccccataaaactcatggaacacaacagatgattctttcagcacaaataccttcagatttggaagcacatcctgatatgtttcttccaagttcatttaattaatagtacttacttgttcttaaatgatttggaagactcccattgggcaggtcaaatcatgggctaaatgtgctggggctttttggtggagatgctaatttaaattttctcaaagtattttacgta

SEQ ID NO: 52492 - DNA, 480 bp, Homo sapiens
tagtaataataagaaaactaactcctttcattaggacttctttttctgagtttagcaaggattggatatttgttgccttttgtttctttgttgggataaacgtgccaggcacaacctgtgcaaccacatatggaagtctgtcttccttcccttactgcctctctattcaattttaacaaataacgttgtatcctatttcttttggaaaatagaacctgtcagaaaagaatatccatgaactactagtaaaatatatcttcctattaacatctgtcaacatgaattcagctttccttcatgttaatataaactgaatatccatgttcatatctacagaaaactgatccacttatatgctagattttatcccttcctgcctattcaaggatatcatttcagaaataccggctgagcgtggtggctcacgcttgtaatcccagcactttaggaggctgaggcgggcggatcacgaggtcaggg

SEQ ID NO: 52493 - DNA, 661 bp, Homo sapiens
tggtttaatgtagaggaagggatccaaaggcttagggagattcagaaggtggagtggattagtcactttagacctactcatcccagctgggagggtccagaagatatacccttgactgatgccttgcaaaacagatttacaagggcagcagctacatctttgaagaaccctataattgcacttctctgtatgtcagatctaacagtgggaacctcagtcactcaactacaaaatttaaatacaaaatgggaataactggatccggaggtagcaggggccaagtgacggcactcaactatcaaaggtaaggtgggcgtagctactgtaatggacagcagaagcaaagcagcaatcagaatagtctgacttgtgtagaacttgggcattggctaattaattatggtgttcctggaagtgaaactgataggaagcctactgcattcccacttaatttatacaagcagaaaacttctaggtcaaatggacaaaatactaatttgaattattaaaacagaatcacggcccctcaatcaatttccagacttgagccagtttacacacccagagccccaatatttgacctatagcatgacatgtattgtttaacttaaaatcagcatctgctacaaatggcaataccagtacattaaaaatgttaaaa

SEQ ID NO: 52494 - DNA, 444 bp, Homo sapiens
ggttaagagacagaacatgaagctcagggttggattgaacagactcagcacagtcagtcagatccagtttatcatcatttgcttcacatttatctaaaactgtaacagcatacccgactgttctaaagagaacactacatgttatagcttatatatttacatcaaccaaaacacatgctatttcctttgctataaatatgccaccttctggctgggcgcggtggctcacgcctgtaatcccagcactttgggaggccgaggtgggtggatcacctgaggtcaggagtttgagaccagcctggccaacatgatgaaagccctgtctctactaaaaatacaaaaattagccgggtgcctttgatcccagctactcaggaggctgaggttgcagtgagccaagatagcaccactgtactccagcctgggagacagactccatctccc

SEQ ID NO: 52495 - DNA, 772 bp, Homo sapiens
ttcagtggcatcattgcactgtgactgtgcaggtcccaaacagtatggacatgaatgtcctcaagctgcatgttagcagggcttctaattccatctgcaagtgatagtgtgtggagcttagttgcacagagcgcatgttactggaggagatatgggtctgtgtcatcctgcatgggaatgatcctaaaaacaaagtgatcagtgactgctcaggactgtggaaaggtcacttggagcagtgggaaaaggtctggcagaggaataagaagatacaggtcttagaacaagccctgggacttcaaccaagtcatttaacatctggggccttcgtttatttatcctcccagcagataaagcaatacctgccctgtcttcctaaccttggaggggtcaaaaaagtgatgggtgtgaaagcattttgtaaactgtagtgcaagcatacggcaggggagtgaaccatactttcactagcgacttgaatgaggtgataaagaaaaggctcagaacttcagaaaatgcaagaggggcttgaccctggattggcagaggaaagcaatggtgggatcgataccttggagagccaaggaccaaggggttaagggtccatgaggacaggcctggatcatcaggaagctgagtgtggtaagactgtggcttcttcagggattgggtggagtacagtcctgccaagaccacagtaactcagggcttggagacatcacaaaggcaggggctcctagagctgagataatctggagaagaggatacccat

SEQ ID NO: 52496 - DNA, 511 bp, Homo sapiens
ttcagtggcatcattgcactgtgactgtgcaggtcccaaacagtatggacatgaatgtcctcaagctgcatgttagcagggcttctaattccatctgcaagtgatagtgtgtggagcttagttgcacagagcgcatgttactggaggagatatgggtctgtgtcatcctgcatgggaatgatcctaaaaacaaagtgatcagtgactgctcaggactgtggaaaggtcacttggagcagtggggattccaagagtctcaaggttagagaagtcgcctagtccacctcccctctctgcttctcacagaagggtctgctgaacactctggtgacagagaactcacccaacatgttccatggcagaggcttttcattagatcaaggtgacatctgttttactggagcttccaaccacgtgtcccaatactgcccttagtcacaggcatccaggtcctctctctcaggacagcactttgaataaatgaggacagctcccatccccctttctccca

SEQ ID NO: 52497 - DNA, 1029 bp, Homo sapiens
ttcagtggcatcattgcactgtgactgtgcaggtcccaaacagtatggacatgaatgtcctcaagctgcatgttagcagggcttctaattccatctgcaagtgatagtgtgtggagcttagttgcacagagcgcatgttactggaggagatatgggtctgtgtcatcctgcatgggaatgatcctaaaaacaaagtgatcagtgactgctcaggactgtggaaaggtcacttggagcagtggggattccaagagtctcaaggttagagaagtcgcctagtccacctcccctctctgcttctcacagaagggtctgctgaacactctggtgacagagaactcacccaacatgttccatggcagaggcttttcattagatcaaggtgacatctgttttactggagcttccaaccacgtgtcccaatactgcccttagtcacaggcatccaggtcctctctctcaggacagcactttgaataaatgaggacagctcccatccccctttctcccagttgactttccagaaacatctcatattgttgttggctttccaccatttttcctcttcacttcctgggcctactactacactgtgtgtcctccacttggtctcttcctgaaagcaacactgtgcacaatgttcctgggggcagacttattaaaccaagtggaccacttccttcaaaaaaaaaaaaaaaaaaaaaaaaaaaaaaaaaaaaaaaaaaaaaaaaaaaaaaaaaaaaaaaaaaaaaaaaaaaaaaaagaaaaaaagaaaagaagagaggggggcgcgcgcgcgcccgaaaagctccaccgaggggggcgacacaagaaagaacagagcgccccaccaaagctttagaggaagagaagcgggggagccacaaaaaagaggggacacggcaacaaacaaacacacagggagcagagggcgggggacgcaaaaaagaagcgcagagagagaggaaaaccaagcacacaaacgcaagacgaacaacatagagaacgacgcacacaacaggagaggag

SEQ ID NO: 52498 - DNA, 910 bp, Homo sapiens
ttcagtggcatcattgcactgtgactgtgcaggtcccaaacagtatggacatgaatgtcctcaagctgcatgttagcagggcttctaattccatctgcaagtgatagtgtgtggagcttagttgcacagagcgcatgttactggaggagatatgggtctgtgtcatcctgcatgggaatgatcctaaaaacaaagtgatcagtgactgctcaggactgtggaaaggtcacttggagcagtgggaaaaggtctggcagaggaataagaagatacaggtcttagaacaagccctgggacttcaaccaagtcatttaacatctggggccttcgtttatttatcctcccagcagataaagcaatacctgccctgtcttcctaaccttggaggggtcaaaaaagtgatgggtgtgaaagcattttgtaaactgtagtgcaagcatacggcaggggagtgaaccatactttcactagcgacttgaatgaggtgataaagaaaaggctcagaacttcagaaaatgcaagaggggcttgaccctggattggcagaggaaagcaatggtgggatcgataccttggagagccaaggaccaaggggttaagggtccatgaggacaggcctggatcatcaggaagctgagtgtggattccaagagtctcaaggttagagaagtcgcctagtccacctcccctctctgcttctcacagaagggtctgctgaacactctggtgacagagaactcacccaacatgttccatggcagaggcttttcattagatcaaggtgacatctgttttactggagcttccaaccacgtgtcccaatactgcccttagtcacaggcatccaggtcctctctctcaggacagcactttgaataaatgaggacagctcccatccccctttctccca

SEQ ID NO: 52499 - DNA, 1428 bp, Homo sapiens
ttcagtggcatcattgcactgtgactgtgcaggtcccaaacagtatggacatgaatgtcctcaagctgcatgttagcagggcttctaattccatctgcaagtgatagtgtgtggagcttagttgcacagagcgcatgttactggaggagatatgggtctgtgtcatcctgcatgggaatgatcctaaaaacaaagtgatcagtgactgctcaggactgtggaaaggtcacttggagcagtgggaaaaggtctggcagaggaataagaagatacaggtcttagaacaagccctgggacttcaaccaagtcatttaacatctggggccttcgtttatttatcctcccagcagataaagcaatacctgccctgtcttcctaaccttggaggggtcaaaaaagtgatgggtgtgaaagcattttgtaaactgtagtgcaagcatacggcaggggagtgaaccatactttcactagcgacttgaatgaggtgataaagaaaaggctcagaacttcagaaaatgcaagaggggcttgaccctggattggcagaggaaagcaatggtgggatcgataccttggagagccaaggaccaaggggttaagggtccatgaggacaggcctggatcatcaggaagctgagtgtggattccaagagtctcaaggttagagaagtcgcctagtccacctcccctctctgcttctcacagaagggtctgctgaacactctggtgacagagaactcacccaacatgttccatggcagaggcttttcattagatcaaggtgacatctgttttactggagcttccaaccacgtgtcccaatactgcccttagtcacaggcatccaggtcctctctctcaggacagcactttgaataaatgaggacagctcccatccccctttctcccagttgactttccagaaacatctcatattgttgttggctttccaccatttttcctcttcacttcctgggcctactactacactgtgtgtcctccacttggtctcttcctgaaagcaacactgtgcacaatgttcctgggggcagacttattaaaccaagtggaccacttccttcaaaaaaaaaaaaaaaaaaaaaaaaaaaaaaaaaaaaaaaaaaaaaaaaaaaaaaaaaaaaaaaaaaaaaaaaaaaaaaaagaaaaaaagaaaagaagagaggggggcgcgcgcgcgcccgaaaagctccaccgaggggggcgacacaagaaagaacagagcgccccaccaaagctttagaggaagagaagcgggggagccacaaaaaagaggggacacggcaacaaacaaacacacagggagcagagggcgggggacgcaaaaaagaagcgcagagagagaggaaaaccaagcacacaaacgcaagacgaacaacatagagaacgacgcacacaacaggagaggag

SEQ ID NO: 52500 - DNA, 670 bp, Homo sapiens
aggaccctaaaacaaacttcaaagagctctaaggacttctcaaagtcctttttggatagtaatgcaatgtctgtgacgtccaaaggaagaaaattcgtcagcggagatttgaactaaaattacttgtgctcatcagcagtttttgaagatgcagagcgctcggttatgaaaatagaacaaaaatgcacatctagtttgtccttagcacttctggttcatcatactttgaaaaagcctggcctgttgcccaagtcttttgaggcaaccctgggttgttgcccaagtcctttgagggtaagcaacagcaatgtctcagaaaacattaactcaacagcccacccgctccaattcattaagccctcatcttttttatctgaccaatagatgcccccagttaagatctaaatgactcttccaatgcagggttgttaaaggaagggagatagacattctgaaaagcagagatctgtttgattttcgggttattatagaacatggatggagctggaggccatcatccttagcaaactaacacgggaacagaaaaccaaataccgcatgttctcacttagaagtgggagctaagtaatgagaactcatggacacaaagaggggaacaatagacactggggcccacttgagggtggagggtggaaggagagagaggagc

SEQ ID NO: 52501 - DNA, 445 bp, Homo sapiens
acgtggccatgcggtggtgtgcaggcatagtgtgggtgtgtgtgtgcttctacttcaggtgtgtaaatacttggcacatacttgcctatgtgcacaggcatgtatctcaagtgtgtttatacagatgtgtctacattgtgttcataggtgggtgtgtgtacacaggtagatgcgtacacattgtgtgtaatgtggatatggggatccatacattgtatacatatacaggtgtgtgcaaaattgtgtgtgtacatatacagctgtgtacaaatggacatgtgtacatggtagtgtatgggtagagatatatcgtgtacatgtaagggtatatgtgtaagtatgtatacacatacatatgtcatctaggtgattgtgaacacagcatgtgtgtatatgtgaatgtgtatacatatatatgtatatatatacactttgtgtatctata

SEQ ID NO: 52502 - DNA, 455 bp, Homo sapiens
gagacagagtcttgctctgtcgcccaggctggagtgcagtggcgtgatctcggctcactgcaagctctgcctcccaggttcatgccattctcctgcctcagtctcccaagtagctgggattacaggagcccaccaccacgcccagctaatttttttgtatttttagtagagatggggtttcaacatgttagccaggatggtctccatctcctgcccttgggatccgcccacctcagcctcccaaagtgctgggattacagacgtgagccaccgcgcccagccgcctccagccatattttaaagataaaataattgtgcaatctctattactatcatttaattcccaaagttcccgctttccctctggtatcatttcccttctaccaagagtttcctttggcatttcttttcaggcaagtctgctggcaagaaatatatatcttaggtttgtttca

SEQ ID NO: 52503 - DNA, 322 bp, Homo sapiens
gatgtttgaattacccggagttgaactagaaaatcagcttttcttaagagtgaattttaaactaaaatcttctgagagatgaaatatatctgtttctatagtattatttggagtagataactatttttaaatttcagcatattaaagtttaaattagggacaaacagtagattatcttctataacttttatttgaataaaagcctaaaatgcttttagaatctaagctcttattttgatttcattttattttaatgtactgtataacagatccaatttactattgacaaatttcgtagcatttattattactatgcacaaaa

SEQ ID NO: 52504 - DNA, 393 bp, Homo sapiens
agcttgctttttcattctcttaacaatgtctttcatggaccaaaaattttaattttgttaaggtcatttatcaattttttttttcctatggactgtgcttttggtgtcaaatctgagaaatctgcctggccctagatcctaaagattttctcctttggttgtttctaaaagttttataagcttacattttacatttaagtccatgatctattttgtcaatttttgtacaaggtgtgagataaaggccaaagttcttttttcttctcccttatggatgtctagttgctccagcaccattcattgaaaagtctattctccctccattgagttccttttgcagtgaaaaatcagttgggcagatttgtgcatctctaattctggattctctgtccc

SEQ ID NO: 52505 - DNA, 434 bp, Homo sapiens
tagtgggatgtttgcattgaatattctcaagttgatcaggtattctaaattaattttaacttctgagtctccaggaaagctttcagaatttatacttactacccaggtgagaagttgcagtaaaataaaagtgaatctttcccaaacttgtggaatattagagttggaacaggccttagaaattccagtgcttcatttgccacatgagaaggctgatatctgaaccaaacagataacttcagaacctctggataccaaacttgtgaagctaaaacagaaatgtcaacttgggatttaaaggaaaatagtaatgcatagaaatggttttgaaaagaaggttttagatatttttgtgctccatgttttcctgcatatgtctcccttttctctgccaaactgcttttcacacccggtccttggactctttgagcact

SEQ ID NO: 52506 - DNA, 401 bp, Homo sapiens
aaagctcggtcagctctagggaggctgaggaggctccggggtctcactctgttgcccaggctgtggcataatcacagctcagtggagcctcaaactcctggtgtcaagcagtcctccctagctcaggctccccagtagctggggatacagacaagccaccgtgtctaattttctcattttctcaggagttcaagaccagcctggccaacatggtgaaacgtcgtctatcctaaaaatacaaaaataagctgggcgtggtggcagatgcctataaccacagctactcgggagtctgatacaggagaatcgcttgaacctgtggggttgaagttgaagtgagccaagatcatgccattgcactccagtttgggcaacagagaaagattttgtctcaaaaaaaa

SEQ ID NO: 52507 - DNA, 332 bp, Homo sapiens
tgaatacaatggatattcaaatatccaatacattccctcatttggaaaagacctctggcttatcagtgctggtctttttaaccagtgccatcgtgtctattcaattaaactatcagatgattaaggaagagggcattgcatcattgatgtaaaagaatttttactataagcttcctttaagagaagagcaggcagcgtagaaagaagcagaaaggacatcgactttgaaatcacgcctgggtggattcaaatcctgattctgtcacttacggccgatgtgatgttaggcaagtacttaatccctcccagctttgattccttcatgcagtagt

SEQ ID NO: 52508 - DNA, 463 bp, Homo sapiens
cccacagacgtgtctttgtgccagaacattcggccttcatgctaatgtccctgaacaaatgatgataatcaccatttactaagcacattctaaactgcctggcctgtgctgggtgtttctggaagcccattttacagatgagaatgccaaggctcagggacattaagtaatttgcccagggttgtacagcttcataagtggcagcaaaaggatttgcattcgggtgggtccaacccagctctgacctgggagtacagattgtttcctatgcaggaattttatgagctggttgttaaaggaaggtactattaagagtcactttatggctgggtacagtggcccatgcctgtaatcccagcactttgggaagcacaggtgggaggattgcttgagcccaggagttcaagaccagcctgggcaacagggagatcccatctctacttaaatatacatatatatttaa

SEQ ID NO: 52509 - DNA, 87 bp, Homo sapiens
tttcagagatagtccccatttgtttggcaagccttggctagatatttgcaggacctaagtctttatatgggagggcatctcctacag

SEQ ID NO: 52510 - DNA, 2121 bp, Homo sapiens
cgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcggtgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatagaaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgactctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 52511 - DNA, 2328 bp, Homo sapiens
cgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcggtgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggtggggctggaccacgtgagcaaaatctgggcgaggcggagctttggagggcgacggggcctgctggagtgggtgggactgaaatgaaggtgagggtgagaaggaagctggaaatggagttgagctgggagcggaggtcaggtggggactgggctggagactggggggactcgcctttttctctgaccgcccaccctttgtgctcaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatagaaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgactctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 52512 - DNA, 2281 bp, Homo sapiens
cgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcggtgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagacagaacaaatacagatcttctaaacaccaggagaagaactgaactgtcccaatcttctgagtcgcctggtctgatgccagttttcctcatccccaggaagatgatgagatgatgctcacgggtagacttatcaaggcacttgtggatgtaccccagcagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatagaaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgactctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 52513 - DNA, 2288 bp, Homo sapiens
cgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcggtgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggtgggtgagacaaccaccccacccccacttgccactctccccgcctaaagctcttgtggatgtaggggtcttccccggttggcagggaggggtgtgaggaagtcccactgatgcttgtgtagtgcaagtttcctaggtgactccttcctttctcttcccttgtttaggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatagaaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgactctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 52514 - DNA, 889 bp, Homo sapiens
ggccactgcaccccagcctgggcaacagaatgagactctgtctcaaaaaaaaagaaaaaaaaaaaagatggagcctggagcccagaggcaaggtgacttactcctacaatctttgtagcagaacaggacctttgtagcagaaccaaaacctcccaactcccagttgacatggtagccaccttctctggtgagtgaagggattccacatccccagcagtgcagttggtgagaaggggcagtcagtcttcaaggatttgctccggtgtggcttcattcaatgctgcccacctctggtgcagcctcagctttgcctctgctctttgcaatgtagcctagaggtcttttttctccttaacaggttttattccctttgttcctcccatccttcatgtccttggcattgctttcttcaaaggaagcctcaaagaactgaaccttgagactgtttctccttttgagatattgtttccacattcattttatattaagttgtctaggagggttagttctcatttaaatgaatgttgtccttgtcaaggttaacattcccactggcaacatagcaagactccatctctacaaaaaataaaaaaattagccaggtgtagtggcatgcacctgtagtcccagctacttgggaggctgagatgggaggatcgcttgagcccgggaggctgagcctacaatgaaccatggtcatgtcactgcattccagtctgggcgacagagtaagactctatctcaaaaaaacaacacacacacaacaaaaaaattgtggggcgcctggcgctcagaaaagtcttaaaaccatgttgggcgcgggccccacaggtattacaactgacaccccggtcctcagaaccggcacacacggtggtctcccctaaag

SEQ ID NO: 52515 - DNA, 713 bp, Homo sapiens
cctgacctcaagcaaattcacctgccctggattcccaaagtgttgggattacaggcgtgagccactgcacgtggccgaggactgacactttgagttgtgactcaaaggtcgttgaagtacatctcagaagatttggaccattacatagtaggacatcttgcggcagagactgaacaattgaaaagactaaattcaggggttgtagttttacttgcaaaattgacgtacagttgacgttaatcacccagaatgcagaaaaacagcaaaggaatcctaaatggggatcattcataacacatcgcttttgatccatgtttaattgggtgccaccaacctcagcattagctttcattttaattagtgacatggaagagcaagagaacatatcttgagaacagtgctatattaaggaaagctctgcaagaaatcaaaataagattctactagaaaacctgctaaggagtgcccgggggtaggtggggaagtatggaaaggcaagaaccgaagtctagctaggcagtgtcaggagacacctggaaagtggtagtcagctagaggaaattgccacaaaattagatggaaattttcagtgttgagggatctaaaaaagaccaatgtgattcagtccagtgcatagatgcagaactcatactgcaaatgtccaaattgtccttcctgtcttttcttgtcaaacttggccttgccatatgcaa

SEQ ID NO: 52516 - DNA, 476 bp, Homo sapiens
ccatagtctaattattcttcaaatttatgttttaattatacttcttccattcagttgtatcttaatatatttttatatgtgaaagtcttttactgaccactctatcatatataatgcaataacaatatataaaaaaattaagtctaaatttaaaaatcccagtgcttccagcttgggcgttagggccattatggacaagttacagtgctgcagagattttatttttggccagttttggggccagtttatggccagattttggggggcttactcccaacactgaggagttaagattattgttcttcttctggagtgatgtcagcaaaagagaagggaaggtccaaggtctccttccccatcctctatctttaagaaaaatgaaaagcaggcactgttattaccaactttgtaagaactctgaaaaatgctcaagtttttcagcaaccaagcaaatgctgaatttcaaagcagtagga

SEQ ID NO: 52517 - DNA, 472 bp, Homo sapiens
ggagaattgagtgttttgatcaaaggtagcctatttagctgtaaaactgtctagaattatttcattcctaggataaaggaaaatttgtgtccaaaatatctctaaaggtattacactgtattcctttaatcttaatgatacacttttttttcttataaatgtagcacattatacactagcggtcttcagtatgataaacagatcaactaccaatttcattgccattactctttgaaatagtcctcattgagagttcttgaaacctgtgtctaataacaaagtaaaatataatcaaaaatttcacacaagtagaagaaaaaacattgacaaatctcttgggagaccacatacttatttttaacaagatgaatgaaatatattcaacctgtaaaatagtttgcaaatgttcatgtgctatattacattgcgtggagttcttattacagatgcaatttcctacaacattaaatct

SEQ ID NO: 52518 - DNA, 402 bp, Homo sapiens
agaagggcagaattatggaactggaaggcatctagttcagttttctcaatttgaaaatagaataaccgtggtctagagaggttaaacaggttacccaaggtcatatgctttaagttcagtgttgggatgagatgcccatctgctcatttccagcctgcagctttgttgccatggtgctcccttttacaaaccagtaaagatgtgttggagtaggtgatgatatccgttaactgatgttaggccatacagttttaatttgctccttctccaccccatctaaatgttcagacatcaggacacatgagaaataataaaaagtgatccttgggtgtgcaagtttagtggtcaaactgacccagcactattcacttggtagaaaaataattaaatagtgctggaaaa

SEQ ID NO: 52519 - DNA, 291 bp, Homo sapiens
atcaactcactcggccagaacccctcgtgtgtcgggggacccagaggcaggggtgaagccgctgctggggatccaggcgcactcactcaccctttgcgctccccagtccccaggggatgcaccttcctcgtcccaaccccgtgcactgctgcacccccagccagccccgtgctctcctccgctgatccggccgcctacccgaggcagtctcggaaccccggaccccagccatgcgcgcagggaactgccgggccgagcgagctcaccgaagtagtcccgcgccgtgcgcgc

SEQ ID NO: 52520 - DNA, 529 bp, Homo sapiens
  misc_feature (1)..(4): n is a, c, g, or t
  misc_feature (6)..(6): n is a, c, g, or t
  misc_feature (11)..(11): n is a, c, g, or t
  misc_feature (13)..(13): n is a, c, g, or t
  misc_feature (223)..(223): n is a, c, g, or t
nnnntnttctncnagcaatttcgagtgcaagtgcacagtgtcagctaaagaaacacaactgcgggttttctgcagagcaaaatggttctgaaatgtcactgaatagctcacaaaggacgccaatctacgacaacagagacataagcatataggagaaagggtccacacatcctcctttcaaagtgtggagaaaagagagagaaagggagagaagagtcatggnaccctactttatggttgccatggatgcaaggtcagccttccacacttggatctaccagcagagttcagacaggtcaacgtgtgaccggctcaggccctggggttaaaagttcaagcagctatggaaaaaccaatatgtccacgcagagtatgctgtacaatttatttcaatttacatcaagccatgcatataaaatttagataaattccattcagatctgatgttgcctgacacacaatgtatgcaaacagatgtctgtggggctttttctgtgctttagaaaacaacattaaatttaaaaatatg

SEQ ID NO: 52521 - DNA, 680 bp, Homo sapiens
  misc_feature (1)..(4): n is a, c, g, or t
  misc_feature (6)..(6): n is a, c, g, or t
  misc_feature (11)..(11): n is a, c, g, or t
  misc_feature (13)..(13): n is a, c, g, or t
  misc_feature (223)..(223): n is a, c, g, or t
nnnntnttctncnagcaatttcgagtgcaagtgcacagtgtcagctaaagaaacacaactgcgggttttctgcagagcaaaatggttctgaaatgtcactgaatagctcacaaaggacgccaatctacgacaacagagacataagcatataggagaaagggtccacacatcctcctttcaaagtgtggagaaaagagagagaaagggagagaagagtcatggnaccctactttatggttgccatggatgcaaggtcagccttccacacttggatctaccagcagagttcagacaggtcaacgtgtgaccggctcaggccctggggttaaaagttcaagcagctatggaaaaaccaatatgtccacgcagagtatgctgtacaatttatttcaatttacatcaagccatgcatataaaatttagataaattccattcagatctgatgttgcctgacacacaatgtatgcaaacagatgtctgtggggctttttctgtgctttagaaaacaacattaaatttaaaaatatgtctctgggatttctttattgaattacaaaatgaacataattttaacttaaatgttttcattcttttttccaatttttttgtgtgggggtcttaataatttctcagttctcaatctactctatgtcatattaaagaggataatgtatattta

SEQ ID NO: 52522 - DNA, 1402 bp, Homo sapiens
  misc_feature (1)..(4): n is a, c, g, or t
  misc_feature (6)..(6): n is a, c, g, or t
  misc_feature (11)..(11): n is a, c, g, or t
  misc_feature (13)..(13): n is a, c, g, or t
  misc_feature (223)..(223): n is a, c, g, or t
nnnntnttctncnagcaatttcgagtgcaagtgcacagtgtcagctaaagaaacacaactgcgggttttctgcagagcaaaatggttctgaaatgtcactgaatagctcacaaaggacgccaatctacgacaacagagacataagcatataggagaaagggtccacacatcctcctttcaaagtgtggagaaaagagagagaaagggagagaagagtcatggnaccctactttatggttgccatggatgcaaggtcagccttccacacttggatctaccagcagagttcagacaggtcaacgtgtgaccggctcaggccctggggttaaaagttcaagcagctatggaaaaaccaatatgtccacgcagagtatgctgtacaatttatttcaatttacatcaagccatgcatataaaatttagataaattccattcagatctgatgttgcctgacacacaatgtatgcaaacagatgtctgtggggctttttctgtgctttagaaaacaacattaaatttaaaaatatgtctctgggatttctttattgaattacaaaatgaacataattttaacttaaatgttttcattcttttttccaatttttttgtgtgggggtcttaataatttctcagttctcaatctactctatgtcatattaaagaggataatgtatatttacaactacagcttcagtgtcattgtagttatagattctatttatatcccttaccactttccgcaaatatttagtgattgatatttctgatttatctctggtttctagcctcatctccattcctttctactttgaacatagcaagtcctggaggctgctgggtcgtcttccagccacaaggtggctcccctcaatcgccttctctcaagccaatcgatgtacacctttgctgagttctccaggcggactacaattcagagctaattatgatctataaatgccattattttcattgtgaagtaaatggcttatgaccaagaccctggtacactaagatacaatgcaaaattagtctttaaaaataggagaaagaaaaatacctttgtatttgcctaatttctcttcacccatccttccaaaagtacaactgagctatccttagagtaaaataagaaaaataataaaaggctccagaggaacctaattttgttgtcaatgaacatagtcatagactagacaaggtcaaattttaagaaaagtatacaacttattctcacttaaactagacctacttttggatttgatattttaccacaagagagttttgatgagaagactttgcaaaactttcttagaagtcccacatcatgccatcattgaagaacagtgatctccaatactgcaaggctttaaaaggagtggaaatattacatatttccttttt

SEQ ID NO: 52523 - DNA, 1252 bp, Homo sapiens
  misc_feature (11)..(11): n is a, c, g, or t
  misc_feature (27)..(27): n is a, c, g, or t
  misc_feature (40)..(40): n is a, c, g, or t
  misc_feature (47)..(47): n is a, c, g, or t
  misc_feature (54)..(54): n is a, c, g, or t
agaggaggagngcttgacatccggttngctgacacggttnctatccnggaccanggagggagaaaacctatggttcctactttatggttgccatggatgcaaggtcagccttccacacttggatctaccagcagagttcagacaggtcaacgtgtgaccggctcaggccctggggttaaaagttcaagcagctatggaaaaaccaatatgtccacgcagagtatgctgtacaatttatttcaatttacatcaagccatgcatataaaatttagataaattccattcagatctgatgttgcctgacacacaatgtatgcaaacagatgtctgtggggctttttctgtgctttagaaaacaacattaaatttaaaaatatgtctctgggatttctttattgaattacaaaatgaacataattttaacttaaatgttttcattcttttttccaatttttttgtgtgggggtcttaataatttctcagttctcaatctactctatgtcatattaaagaggataatgtatatttacaactacagcttcagtgtcattgtagttatagattctatttatatcccttaccactttccgcaaatatttagtgattgatatttctgatttatctctggtttctagcctcatctccattcctttctactttgaacatagcaagtcctggaggctgctgggtcgtcttccagccacaaggtggctcccctcaatcgccttctctcaagccaatcgatgtacacctttgctgagttctccaggcggactacaattcagagctaattatgatctataaatgccattattttcattgtgaagtaaatggcttatgaccaagaccctggtacactaagatacaatgcaaaattagtctttaaaaataggagaaagaaaaatacctttgtatttgcctaatttctcttcacccatccttccaaaagtacaactgagctatccttagagtaaaataagaaaaataataaaaggctccagaggaacctaattttgttgtcaatgaacatagtcatagactagacaaggtcaaattttaagaaaagtatacaacttattctcacttaaactagacctacttttggatttgatattttaccacaagagagttttgatgagaagactttgcaaaactttcttagaagtcccacatcatgccatcattgaagaacagtgatctccaatactgcaaggctttaaaaggagtggaaatattacatatttccttttt

SEQ ID NO: 52524 - DNA, 869 bp, Homo sapiens
  misc_feature (1)..(4): n is a, c, g, or t
  misc_feature (6)..(6): n is a, c, g, or t
  misc_feature (11)..(11): n is a, c, g, or t
  misc_feature (13)..(13): n is a, c, g, or t
  misc_feature (223)..(223): n is a, c, g, or t
nnnntnttctncnagcaatttcgagtgcaagtgcacagtgtcagctaaagaaacacaactgcgggttttctgcagagcaaaatggttctgaaatgtcactgaatagctcacaaaggacgccaatctacgacaacagagacataagcatataggagaaagggtccacacatcctcctttcaaagtgtggagaaaagagagagaaagggagagaagagtcatggnaccctactttatggttgccatggatgcaagcctcatctccattcctttctactttgaacatagcaagtcctggaggctgctgggtcgtcttccagccacaaggtggctcccctcaatcgccttctctcaagccaatcgatgtacacctttgctgagttctccaggcggactacaattcagagctaattatgatctataaatgccattattttcattgtgaagtaaatggcttatgaccaagaccctggtacactaagatacaatgcaaaattagtctttaaaaataggagaaagaaaaatacctttgtatttgcctaatttctcttcacccatccttccaaaagtacaactgagctatccttagagtaaaataagaaaaataataaaaggctccagaggaacctaattttgttgtcaatgaacatagtcatagactagacaaggtcaaattttaagaaaagtatacaacttattctcacttaaactagacctacttttggatttgatattttaccacaagagagttttgatgagaagactttgcaaaactttcttagaagtcccacatcatgccatcattgaagaacagtgatctccaatactgcaaggctttaaaaggagtggaaatattacatatttccttttt

SEQ ID NO: 52525 - DNA, 521 bp, Homo sapiens
gggtggccatggtggagatcagcagcagcttccccacccaggacaaggcctagaggctcccagggtgatggagaatgcttcagagacagaaaaatgtgagccctagaagtgggaggctgacagcctgcatgagaactatccactgtacctgcatgtggactcgaagacagtctccgggaatatgggctgaggaatccacagtgtcagatgaggaaactgagacccaaaaagagacagcaactggcccagggtcaccagcatgcagatgcctgctatgatgtctctgcttcttgtgtctgtgggcctcatggaagcacttcaggcccagagccaccccatcacacgacgagacctcttgtcagcacagatgtaacttctgctctaatccatgagtcctgaggctcctctcatcacggctcactgtagcctcaaactcctggtttcaagagatcctcccacctcagcctcccaagtagctgggactacagatatgtgccaccacacctgactaatttttgtgt

SEQ ID NO: 52526 - DNA, 1315 bp, Homo sapiens
gggtggccatggtggagatcagcagcagcttccccacccaggacaaggcctagatgaggaaactgagacccaaaaagagacagcaactggcccagggtcaccagcatgcagatgcctgctatgatgtctctgcttcttgtgtctgtgggcctcatggaagcacttcaggcccagagccaccccatcacacgacgagacctcttctctcaagagattcagctggacatggccctggcctcctttgatgaccagtacgctggctgtgctgctgccatgacagctgctctcccggatctcaaccacacggagttccaggccaaccaggtgtatgcagacagctggacactggcaagcagccaatggcaggagcgtcaggccaggtggccagagtggagtctcagccccacccgtccatccccgccacccctgggcttccgcgatgagcatggggtggccctcctggcctacacagccaacagccccctgcacaaggagttcaatgcagccgtgcgtgaggcgggccgctcccgggcccactacctccaccacttctccttcaagacactccatttcctgctgactgaggccctgcagctcctgggcagcggccagcgtccaccccggtgccaccaggtgttccgaggtgtgcacggcctgcgcttccggccagcagggccccgggccaccgtgaggctggggggctttgcttctgcctccctgaagcatgttgcagcccagcagtttggtgaggacaccttcttcggcatctggacctgccttggggcccctatcaagggctactccttcttccctggagaggaagaggtgctgatccccccctttgagaccttccaagtgatcaatgccagcagaccggcccagggccccgcccgcatctacctccgagccctgggcaagcacagcacctacaactgcgagtacatcaaagacaagaagtgcaagtctgggccttgccatctggataattcagccatgggtcagagccccctctctgcagtctggtctttgctgctgctgctctggttcctcgtggtgagggcctttccagatggtccaggcctcctttgatgcatgagacacgggacagcctcgcctgctgcctctgcccatcctgaggatgttggccatgtgtgcttcagtgtaaccaagattcctgtcaatcccatctgcagggaactctgggaccttctctggtagctgccagaccggctggtggagaaacaggagacaatctggggactgaaccttacccagggctgtaggagtgagactctgaataaagggttgggccggc

SEQ ID NO: 52527 - DNA, 176 bp, Homo sapiens
gttcccttcagattgattattttgatgcaactttgcctcacttttcagctgatactgtatgtgtagtttttataggtaccatatacgtatacaaatgtaccactgtttttaaatgaagtatgaaaaaaatttaaaatatagtattactacattgagcctatatctgctctaacata

SEQ ID NO: 52528 - DNA, 682 bp, Homo sapiens
gccgactactactacctactactacattggcccccggtcgactttaaagagctcttttagagttagacatagatttttgtcatatgtcacttgcacattcaataagatggaaaacacaagtgaaaaaacacataaggaattgctaaatttcacatatttagagtctgccttctgaattgtttttggagtcagagttgttaatacctgtaattttccgttaaacatcctctgtgccgccaagagaattggtgatgtagcattcctttcaagatcccaaaaaagactgcgaaggttttggtgctggccttcagctttgcaattatgcaaagccagcctactttgactgctgcttagggattccccatcttctacttccttcccagtccatttggttcctagagggtgaaatgaatgctccagtatcatttctgggaatttctttcaggctgttgactgtcatatgcaaatgtcatgctggcagttttgttattttcccatgtgtaagcaatgacaacatcataattggcttctgtctgatagcaattgtaagaggaatcccaatttctgaaatgttacccaaaaaagtgactttaattgacgaagtatgatgatgtagaaggataggcaagaaatgcaaaaggtaatttagaaaggtttcatgggtaaaatgtgacctatgtga

SEQ ID NO: 52529 - DNA, 447 bp, Homo sapiens
gccgactactactacctactactacattggcccccggtcgactttaaagagctcttttagagttagacatagatttttgtcatatgtcacttgcacattcaataagatggaaaacacaagtgaaaaaacacataaggaattgctaaatttcacatatttagagtctgccttctgaattgtttttggagtcagagttgttaatacctgtaattttccgttaaacatcctctgtgccgccaagagaattggtgatgtagcattcctttcaagatcccaaaaaagactgcgaaggttttggtgctggccttcagctttgcaattatgcaaagccagcctactttgactgctgcttagggattccccatcttctacttccttccctcattccttgctctatgtgcatctcttcatctgtatcctttgcgatatcctttataataaaccggt

SEQ ID NO: 52530 - DNA, 343 bp, Homo sapiens
  misc_feature (227)..(227): n is a, c, g, or t
  misc_feature (279)..(279): n is a, c, g, or t
  misc_feature (292)..(292): n is a, c, g, or t
ctaggttcaggccatcctcttgcctcagcctctagagtagctgagactacaggtgcacaccaccacatctggctaacttccaaatcttttctaggaggaccattccatttgcctttttaataaattgtggccaaggaattggttttttttaaaaagccaatttgcacacacatatatcagccatgaattttgtatacactgaaactaagcattatatatgaaagaanagatacagtctttttcagacaaacaaatgctgagataagtcaccactaccangccacaactatangaactgctaaaagaagctctaaatcttgaaacgcatcctgggaggcacatc

SEQ ID NO: 52531 - DNA, 338 bp, Homo sapiens
ccccccacatacttttcagaagtgtgaggaggttgaatgttccagaagaagattcctgacaaagaggctgccctgggacacttcctgcagaggacacgctgcccgatttgtgaggttgcccagaacccccacggcagaggcagtgttcacagaatctcaggaattttaactttccggtcctcaatatcctttcattggctaaaatttaagattttgttttaacagcccagcaagctaagaattaactttttagaacccaggaactaatgtatttgtcagataagccttccctccactctttccacagcatgtccctcaaccagtccctgcattggccc

SEQ ID NO: 52532 - DNA, 233 bp, Homo sapiens
tccatattgttgtaaagcaaggtaatggacaaactgcagtttataggcataagatgaagtaaacaattctactctattacattagtttgtacttgccctgctataaataaatacctgagactgggcaatttataaagaaaggaggtttagttggctcatggttctttcttcaggctgtacaggaagcatgaaagcctctggggaggcttcaggaagactttcaatcatggcag

SEQ ID NO: 52533 - DNA, 473 bp, Homo sapiens
tactgcttcctccctcccatgtctcctggaagaatcagctccttcctggacctgctgcctgctccaaccctcctccctcctttctcagccagacccagttcattcccccaacaccaacaggggcttctgccccttgccccaaagttgctgtgacaaaagtccccaaaggccaggtctaggagatgcctgagcctccactgacctctgtgcatgtggcccaccagtggccactctctttctggaaatgttccttcatgggcttctgggactctctttccctgtcttcccctctttctcaggctcccctccccctgtccaatgctggtgctgcccagggctcagactccagccttccctctcactgtgcaccttttccctcaacttcatgcatccttgaagctttgcctctctcctagaggctgattcccaaaactgatagtccacactgggctcctttaagctccagtccaaca

SEQ ID NO: 52534 - DNA, 282 bp, Homo sapiens
gataatcatgtgtttttgttctttagttgtttagtttatgtgatgaatcacgtttattgatttggttatgttgaagcaacctggcatcctggggatgaagccaacttaatctcagaccaaaccttcttaagcaacttcagcaaagtctcagagtacaaaatcggtgtgcaaaaatcaccaacaacaggcaagccgaaagtcaaatcatgaatgaatttccattcacagttgctgcaaaaaacaaacaaacaaaacctaggaatacagctaacaagggaaggg

SEQ ID NO: 52535 - DNA, 984 bp, Homo sapiens
aatgagtcaggggctgtggacagtgacctgaaccccttccttgcccctagacaagccacagctgacctgctgagcagcctggaggacctggagctcagcaaccgacgtctggttggggagaatgccaaactgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggtgggtctggcccaggggaaggaaggtgccctctctcttctttgtttcctggagtcagggcggcagagtgtgactatggagtaggaaggggcagaggtcacctggctttctccctctctccaggccctgctcaccctagactttttcaagcttacctgccatccttctcatgacaaaggagacagcaggagccatcagggcttcccagacccattcccccaggccctggttgtgttttcaggggtgggagaagggcaacatgggggcaaggaggctagaaatgaaacctttgtcctctctctggggttggtcaggaaaaggagcagcagcatctggtggctgagatggagactctgcaggaggaggtgagcggaggcccagcaccacccccaccccttccccagtccttaaggtcttcttgacaccactcccttctgcccccaacaccccagcagcctgtcttggggagacctcagaatgtcagtagtgtgggaatgtccctgaggttatatcacactgtgagaacagccgtggtttacaagagtgtgaggcatggggtcagcctacatggcttcaggctgaggccacctacataagagtggaccagtgcctcccttctctgtgcctcagttgcctcacctataaagatgaaca

SEQ ID NO: 52536 - DNA, 1525 bp, Homo sapiens
tgtgtcccgagactaggacgtggctccaggagtgctcgggccagctggtccttttcccatccctccccatgaaggagggaggctggtagctttgccagcagctgcgccgcggcaggggtggcccatggacctgcctgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccagcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaactgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggtgggtctggcccaggggaaggaaggtgccctctctcttctttgtttcctggagtcagggcggcagagtgtgactatggagtaggaaggggcagaggtcacctggctttctccctctctccaggccctgctcaccctagactttttcaagcttacctgccatccttctcatgacaaaggagacagcaggagccatcagggcttcccagacccattcccccaggccctggttgtgttttcaggggtgggagaagggcaacatgggggcaaggaggctagaaatgaaacctttgtcctctctctggggttggtcaggaaaaggagcagcagcatctggtggctgagatggagactctgcaggaggaggtgagcggaggcccagcaccacccccaccccttccccagtccttaaggtcttcttgacaccactcccttctgcccccaacaccccagcagcctgtcttggggagacctcagaatgtcagtagtgtgggaatgtccctgaggttatatcacactgtgagaacagccgtggtttacaagagtgtgaggcatggggtcagcctacatggcttcaggctgaggccacctacataagagtggaccagtgcctcccttctctgtgcctcagttgcctcacctataaagatgaaca

SEQ ID NO: 52537 - DNA, 1598 bp, Homo sapiens
cgaaatcctagcgaagcccccccatattgtgggagagatacccctgcgtcagggccccccagatcctgaccacttgggaggccgaggcgggcggatcacgaggagtgctcgggccagctggtccttttcccatccctccccatgaaggagggaggctggtagctttgccagcagctgcgccgcggcaggggtggcccatggacctgcctgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccagcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaactgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggtgggtctggcccaggggaaggaaggtgccctctctcttctttgtttcctggagtcagggcggcagagtgtgactatggagtaggaaggggcagaggtcacctggctttctccctctctccaggccctgctcaccctagactttttcaagcttacctgccatccttctcatgacaaaggagacagcaggagccatcagggcttcccagacccattcccccaggccctggttgtgttttcaggggtgggagaagggcaacatgggggcaaggaggctagaaatgaaacctttgtcctctctctggggttggtcaggaaaaggagcagcagcatctggtggctgagatggagactctgcaggaggaggtgagcggaggcccagcaccacccccaccccttccccagtccttaaggtcttcttgacaccactcccttctgcccccaacaccccagcagcctgtcttggggagacctcagaatgtcagtagtgtgggaatgtccctgaggttatatcacactgtgagaacagccgtggtttacaagagtgtgaggcatggggtcagcctacatggcttcaggctgaggccacctacataagagtggaccagtgcctcccttctctgtgcctcagttgcctcacctataaagatgaaca

SEQ ID NO: 52538 - DNA, 1580 bp, Homo sapiens
tgtgtcccgagactaggacgtggctccaggagtgctcgggccagctggtccttttcccatccctccccatgaaggagggaggctggtagctttgccagcagctgcgccgcggcaggggtggcccatggacctgcctgagggcccggtgggtggccccactgcggaaagaaagaggtaacaccaaccccattttccagaggaagaaactgaggcccaagagaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccagcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaactgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggtgggtctggcccaggggaaggaaggtgccctctctcttctttgtttcctggagtcagggcggcagagtgtgactatggagtaggaaggggcagaggtcacctggctttctccctctctccaggccctgctcaccctagactttttcaagcttacctgccatccttctcatgacaaaggagacagcaggagccatcagggcttcccagacccattcccccaggccctggttgtgttttcaggggtgggagaagggcaacatgggggcaaggaggctagaaatgaaacctttgtcctctctctggggttggtcaggaaaaggagcagcagcatctggtggctgagatggagactctgcaggaggaggtgagcggaggcccagcaccacccccaccccttccccagtccttaaggtcttcttgacaccactcccttctgcccccaacaccccagcagcctgtcttggggagacctcagaatgtcagtagtgtgggaatgtccctgaggttatatcacactgtgagaacagccgtggtttacaagagtgtgaggcatggggtcagcctacatggcttcaggctgaggccacctacataagagtggaccagtgcctcccttctctgtgcctcagttgcctcacctataaagatgaaca

SEQ ID NO: 52539 - DNA, 767 bp, Homo sapiens
gggcagctacagtggggcgctaagcctcatccctttgatacaggggattagagctggaagaggagaccgccttccagggagccctgacctcccagcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaactgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatgag

SEQ ID NO: 52540 - DNA, 1183 bp, Homo sapiens
tgtgtcccgagactaggacgtggctccaggagtgctcgggccagctggtccttttcccatccctccccatgaaggagggaggctggtagctttgccagcagctgcgccgcggcaggggtggcccatggacctgcctgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccagcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaactgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatgag

SEQ ID NO: 52541 - DNA, 1062 bp, Homo sapiens
gagagagaaggaagggaaacggcagagggatgcaaaggctagagctgaattccacaaacccgacttacttttcctggggctcttatgggatccagggccgggtacatttgtgtggttttaacttaacttgagttgagacactcagacatcacaggccagaaatcgtcctcttttacatgaaggaggggagtgtgggagggtggctgctcatggagggattacagacagaaaaagttgcaggggacaaaactcatccagaacgcttttccggtcttttcccaccccaagtgttaagccatttcaccctcttcaaaagcaaacacacaactccgatttgcatgcaggtaagaaaacacccctgctgccacatgggatcctggacttgtgtggcttgaagcaagaccagtggcaaagatttggtttcttctggcggcaggacacctaaggtagagatgtttttaatttactgaactgattgcccatctgtttatctccaagcccacaagactgttttcacgatgtaggtctttaaacaatctgttaagacacgggacaagttaatcaccctcgccgctccccaccaaaaaaatcaacaaaaacaagggctgggcaggcttaaaaataacaaaaaagtgggaattcttcatttcttcttttcttcttttttaaaatactgctccgtggcctctctttctggacttatctggccttcctgtgtaagtgtcaggcagcaatctttaaggcccttaataccaaaaacaaaaccctgccattccctttacatggtggtaacaaaagcaatgagcctccactttgacaagtaaaaagccccaaccacacagccccctaattgccttctctccctctattcacgcggaccaccacactcctggcagctgcttttgtcacacacgcaatttcttaagtaaactgcaagttctctgccgctgatggacagctcccaatcattcagcaacaataacttataaagtgcggcaaacaggatgggcaactttgactaagaatttattttctagctttctcaaaagaccgaaaaatgga

SEQ ID NO: 52542 - DNA, 492 bp, Homo sapiens
cttgctgtgagtctttctgcaagtggtttcacctctctgatcctttgtttcctcattgtaaggtcacattctgattctgaaaagtacaaatggtatttctgaagagggtgaactgggcgctggtctcttctgaggcaggggaaggttgttttttgctctctcggaggatttggttattcaggttgatttgtggcatcctggcctctcaggagtggtagtttcgaggtgtcgatgtgaatgtctgtgactccaattttgtgttcagaacagcaagacagacattctgctaacttcacatggtggagtcttgcagctcgaatcacgaatgcagagtgaaaaaatgctattgataaatattgcctgaactcctcaaagttctgatattttacaaagataatttcctaagttgctaaacctgaagctttctgcttcatagatgcccaaagccaacccttctgttttctctctaatactttgagcttattgaattta

SEQ ID NO: 52543 - DNA, 251 bp, Homo sapiens
caggcatggtggcgcatgcctgtaatcccaactcaggaggctgaggcaggagaattgcttgaatccaggaggtggagattgcaatgagctgagatcacaccactgcactccagctcggacaacagagcaagattctgtctcaaaaaaggaaaaaaaaaaagcgtctaaactcccgaagagaggattcagtgagaatattagtcatgatcctggcttgccattttcttaactttgaaattattctagtttgt

SEQ ID NO: 52544 - DNA, 670 bp, Homo sapiens
ggagggcaaaggtcaagtaaggagtttcggctcaagaaattaatctcacagatacatatacctcgtgagatctttttgtttgagggaagtttttgtttttctttgtcacagaacctctctctgtctctcccctcccccctcccccctcaggcttccagaatattcctgtgtctaggcatggagaggaggcggtcttttattaagagtggacaagatagtgtcttcccctagatgggttagaactgtcctggacagcttctcgaagcttctctctgttctcagtcttcctggaacctctcttcacctcttgcctcttgtgcctaactttcccctgtcctcaatgtctagtctcacttgttttcctcccccaattttaaaacatacagagttcatcgaaagacacataaattttaataggtctgaagctcatggccattggagatgagttaattctcattccctcaagattccctattttgacagctccctaaggaaaacacaacttgctggcttttctgttacttttgtcccccatgagcaattttgcatctgtgcagttggactgaacatctccagtgtgtcaagcgctctcctccagcagacaccccgtgtccagcagcaccccacggggaatgctccccttcaacgagctttgtcgtctctaaaaagg

SEQ ID NO: 52545 - DNA, 1376 bp, Homo sapiens
catcatcctgttgtcctgggcgacctgctgctgcctctgatttggcatttctgtttgggttttggttttggtttttctgtagtcctttcaaagataacttaatgaaacactttaaatactccattttaaaatttaaactcttttaattaaagcacttttcatggaaccctcagtcacgagttatttccccacatccttcagtacttaatctcggagcagaattggaaatatcgatagaaagtgtaaatcatgccctcctgctgaaagcgttgtatcaggtttcggctcaaaagagcaccattacctttagctgtcacggatctgtacacttgatcgataaacttcaaatattattagaggtagaggcttcagagatttgctctgttctttggagagagacagagataaatctttcttaaaaattgacttgaatttgcactctcagtcttcctggtgaaatgcatttctcttaggcatccagcaactgcaagggggacagatttataggccatgtgcttcttgtactgaaagattcaaatggtaaatccttcacatatgacttcacaaatcatgtaaagttaaaagatttttaccgtttctgttgctgctgtgcttaaattgtaaggtacagctagtaaatcattttaatggaggtgtcgtacttgactcaataaaaaaaaaagacaatggtttagcttccactccaaaatgttaatgtattaatcaacgggagaataattgtgttttactacattataaatctcaaatgccattaggatttcagcaaggggtgatgtagccacattcctaaattaaaatggtttacactgccatacatccattctgcatcaccatagctcattctgggttcattttggagttgttccccagccaaacatgtcgttcctcattcagaagaagacatcctgagggggtgatgcttataaaggaaaattaattgcattgcaatgtgttaaataaataaaataaccgtcggtggcaatggacaattattccttgctgtctcttttgaaatatgtttttaggttttaaattgaggcttactccttcatacatcctaaatgtagcaagcccgtcatctgtctttagtcttataatccctgtcttatctctatgcgactgtggcgtttgagcaccttacttctcccatgcatatccctaatctaccagataaataaagtcattgggggacattgaacgaggcggaccctcggtggctaaagggcctcaaagaccttaatacccgggaaccccctaaaaggcccgactggtacgacaggggaccgtacaagcagggggcaatattccacggagccaatgtcccagagaacccaagagatatacctggggcccct

SEQ ID NO: 52546 - DNA, 1318 bp, Homo sapiens
catcatcctgttgtcctgggcgacctgctgctgcctctgatttggcatttctgtttgggttttggttttggtttttctgtagtcctttcaaagataacttaatgaaacactttaaatactccattttaaaatttaaactcttttaattaaagcacttttcatggaaccctcagtcacgagttatttccccacatccttcagtacttaatctcggagcagaattggaaatatcgatagaaagtgtaaatcatgccctcctgctgaaagcgttgtatcaggtttcggctcaaaagagcaccattacctttagctgtcacggatctgtacacttgatcgataaacttcaaatattattagaggtagaggcttcagagatttgctctgttctttggagagagacagagataaatctttcttaaaaattgacttgaatttgcactctcagtcttcctggtgaaatgcatttctcttaggcatccagcaactgcaagggggacagatttataggccatgtgcttcttgtactgaaagattcaaatggtaaatccttcacatatgacttcacaaatcatgtaaagttaaaagatttttaccgtttctgttgctgctgtgcttaaattgtaaggtacagctagtaaatcattttaatggaggtgtcgtacttgactcaataaaaataattgtgttttactacattataaatctcaaatgccattaggatttcagcaaggggtgatgtagccacattcctaaattaaaatggtttacactgccatacatccattctgcatcaccatagctcattctgggttcattttggagttgttccccagccaaacatgtcgttcctcattcagaagaagacatcctgagggggtgatgcttataaaggaaaattaattgcattgcaatgtgttaaataaataaaataaccgtcggtggcaatggacaattattccttgctgtctcttttgaaatatgtttttaggttttaaattgaggcttactccttcatacatcctaaatgtagcaagcccgtcatctgtctttagtcttataatccctgtcttatctctatgcgactgtggcgtttgagcaccttacttctcccatgcatatccctaatctaccagataaataaagtcattgggggacattgaacgaggcggaccctcggtggctaaagggcctcaaagaccttaatacccgggaaccccctaaaaggcccgactggtacgacaggggaccgtacaagcagggggcaatattccacggagccaatgtcccagagaacccaagagatatacctggggcccct

SEQ ID NO: 52547 - DNA, 1091 bp, Homo sapiens
ttctgtggaggggactagaatagccatgttgtagttatcttagaagtcaggggtggggaagggcagggaggagggggaagcaattgttttgtcacacaccatgatgtaaactaactttcccctgtcctcaatgtctagtctcacttgttttcctcccccaattttaaaacatacagagttcatcgaaagacacataaattttaataggtctgaagctcatggccattggagatgagttaattctcattccctcaagattccctattttgacaatttataggccatgtgcttcttgtactgaaagattcaaatggtaaatccttcacatatgacttcacaaatcatgtaaagttaaaagatttttaccgtttctgttgctgctgtgcttaaattgtaaggtacagctagtaaatcattttaatggaggtgtcgtacttgactcaataaaaataattgtgttttactacattataaatctcaaatgccattaggatttcagcaaggggtgatgtagccacattcctaaattaaaatggtttacactgccatacatccattctgcatcaccatagctcattctgggttcattttggagttgttccccagccaaacatgtcgttcctcattcagaagaagacatcctgagggggtgatgcttataaaggaaaattaattgcattgcaatgtgttaaataaataaaataaccgtcggtggcaatggacaattattccttgctgtctcttttgaaatatgtttttaggttttaaattgaggcttactccttcatacatcctaaatgtagcaagcccgtcatctgtctttagtcttataatccctgtcttatctctatgcgactgtggcgtttgagcaccttacttctcccatgcatatccctaatctaccagataaataaagtcattgggggacattgaacgaggcggaccctcggtggctaaagggcctcaaagaccttaatacccgggaaccccctaaaaggcccgactggtacgacaggggaccgtacaagcagggggcaatattccacggagccaatgtcccagagaacccaagagatatacctggggcccct

SEQ ID NO: 52548 - DNA, 348 bp, Homo sapiens
aacattttctgaaggcatacagatatgcccaaagatggacagatcaagcagcttgcctaaagccacaccgctggtaaatggctgagccaggattcatcaacctaggaaggatgtgttttcttaatcacagctaaactaaactaccaaggctatcttatggtacattccaacttcaaatctgcaaatccaaaatcatttgttcaactctgcaaaagttgcatcaaacaaggcttgttaacttttactgtcacagaagcttcaagaacttataacaatgcttagagttgggtaatgaactatgctagttttttctttacttttcaaagtttatttaatgtgcttatattc

SEQ ID NO: 52549 - DNA, 487 bp, Homo sapiens
gaaggcaggcatcctacacactagccaaagacaataattcttccaaagaagaactggaaggctggtaaatgttctgaacccttacttgtctgatgtagcttcattttaccctcgcacttgaatgatcatttatgttcaaagccatttcccctcagagctttgaaaacattgctccattattttcttgtatccaattgtgctaatgaggaatatgatatcaatccaattcttgttcctatgcgtagtgggttggagtgagttacccaaaaagacacatttaagtcccagacccaacccccagcacttgttagtgtgaccttatttgcaaggagggtgtgtgcagatataattaaggatcttgagatgggatcttttagggtgggccctaagtccaaggactggggtccttataagaaaaggaaagaatgcagagacacagagaaggctatgtggagatggaagcaaagagcaggatcatggagctgca

SEQ ID NO: 52550 - DNA, 479 bp, Homo sapiens
acggttctagctccagaaaaaatgacattattgagaagaatccttccttaaggatggcaataactggctcaatgggaccaaaaaaaaaaaaaaaaaacaaaaaatctgacagaaaatctagcagcctagcaagcaggctttttccactttaagaatcgattttagcagctggaggagacagttcaaaggcctgaccactggctgagactcacctgtgctccagagggctattccctgattgctgagtaactgtggaccagctttggtctgggcaaaccagaaaacatctctgccatccagtgggctgcaactacatccagtgggctgcaactacaacaagtcctgaatccagcctagagaatcctccttccaagttagttcttccttgagaactctccttcagctctatggtagcctatggaagttaggctcttattgtcatagtttgtattacttttattaaaactttttaaaatcgc

SEQ ID NO: 52551 - DNA, 355 bp, Homo sapiens
acggttctagctccagaaaaaatgacattattgagaagaatccttccttaaggatggcaataactggctcaatgggaccaaaaaaaaaaaaaaaaaacaaaaaatctgacagaaaatctagcagcctagcaagcaggctttttccactttaagaatcgattttagcagctggaggagacagttcaaaggtaagtgatgattcatcccagagaaacaagttataaacaaaactgggagcagtcagttgaccttgaatcagctgcttcatttatacagtttaactagttataaaggaatataattatatagcaagcacctgtgtaaacaccatctaggtttaacaatgccatcttcc

SEQ ID NO: 52552 - DNA, 331 bp, Homo sapiens
aaattcagaggaacatgtactggggtcttaggaacattttcagccagtggagaggaaaaggaaaactaagtatctcttggatcattcacagagttcaccaaatacaactgaaaactgggggctctaatgtccctgctgccctgatggtattagtttaagatgttgacactgacatctgcagagatctcatccatcacggtatatcaaagagcaaatgtcattctagttgagaaactcatgtatgagaaagaatggtcatcttgggaaatctgtagctccagcggctcctgatgttttttcctgcctcctcctgtcccatgcttgtgcccca

SEQ ID NO: 52553 - DNA, 191 bp, Homo sapiens
tgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaa

SEQ ID NO: 52554 - DNA, 456 bp, Homo sapiens
ccatccctaggtttcacaactagtaagctgagattcggactccaacgtgcatgttcctttcccagtagcacactgcttctcctgaagccgaagttccccttcagagaattatgtagatctcataattccctaggcaaaactggagctctttgaatcccagcctagccatccacactataccagtttaaggtgcaatcttgtgattattgccgctgatcacgattcttgataaggcatccacaactgataagtctgacgcttctgttttacaccaattgccagttgtctcagagtcactgtgaaaggagggaaaagcttatctcttataaagttggttagcttcaaaatacagtgatgtattttgggatatttctgtggggaaagggttacaaggggtcaaatggcatcattaatgtgaacttaatatacccacttgatggattgattcctgtggga

SEQ ID NO: 52555 - DNA, 1500 bp, Homo sapiens
  misc_feature (8)..(8): n is a, c, g, or t
gtctcganttctcgagcatgttggctatggattcagttcccactgcagcgcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggagccagggctgaggtcagtgctgaccaggtggccacagtgatgtgggactacttcagccagctgagcaacaatgccaaggaggccgtggaacatctccagaaatctgaactcacccagcaactcaatgccctcttccaggacaaacttggagaagtgaacacttacgcaggtgacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcaacacgcaggccgagcagctgcggcgccagctgaccccctacgcacagcgcatggagagagtgctgcgggagaacgccgacagcctgcaggcctcgctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccgaggagctcaaggccaggatctcggccagtgccgaggagctgcggcagaggctggcgcccttggccgaggacgtgcgtggcaacctgaggggcaacaccgaggggctgcagaagtcactggcagagctgggtgggcacctggaccagcaggtggaggagttccgacgccgggtggagccctacggggaaaacttcaacaaagccctggtgcagcagatggaacagctcaggcagaaactgggcccccatgcgggggacgtggaaggccacttgagcttcctggagaaggacctgagggacaaggtcaactccttcttcagcaccttcaaggagaaagagagccaggacaagactctctccctccctgagctggagcaacagcaggaacagcagcaggagcagcagcaggagcaggtgcagatgctggcccctttggagagctgagctgcccctggtgcactggccccaccctcgtggacacctgccctgccctgccacctgtctgtctgtcccaaagaagttctggtatgaacttgaggacacatgtccagtgggaggtgagaccacctctcaatattcaataaagctgctgagaatctagcctca

SEQ ID NO: 52556 - DNA, 397 bp, Homo sapiens
gctagacaaaactgagcagagttccttctccaaatacagaggatcaatgcattttagggtcaatgggcccccaagtgtcctggagtttaaccactggctgaatgacaaaggaccctccgtctctgcttagatattctctttgatgaccgggtgcttacttcctcctgaggcaggcctttctgtatctccgccccgcacccctccccccccaaacccccccgccccgccccggcccctgagcaggcggagtctcgctcttgtcacccagactggagtgcagtggcgtgatcttggctcactgcaacctccgcctcccgggttcaagcaattctcctgcctcagcctcccaagtagctgggattacaggcacgaacccagctaatttttgtacttttag

SEQ ID NO: 52557 - DNA, 629 bp, Homo sapiens
aaagaatatccttgctgtgccaagaaagaaaagaccatggatctactagttgcagatttcagcagtaatgccaagggggcaagaagtgaccagcagaacaattaggccatggcaacagaagccaactacaacccatgttccaatctatgacctccctctcctgctggtacaaggatatgggcaagagctgataatcaactgactaatgaggattgacttctacaattgatgagcatggaattggatgtgcctaaatcaacagaagagggattttgatgtcatcacactgtagccccagaagacagaacgctcaaaggtgtcaatgggcagaatttgtagatgacatacagcatccaatggattactcctattcagattgttgttttgtttgctagacatgattttaggattttgtcaaggaagccatctatgaccccaatcaatcaaaaccataaggatcaaggctggaagaacctattccttagagcaaaggatgcaatgtcaagcaagttgtgatacctcaactatctacaatttaacaccaaggaaagaacactgtttggagaaatgagaaagattatcatcagtgtctttcagaagtcatcaaaagaagaaaaggagaaaagaga

SEQ ID NO: 52558 - DNA, 670 bp, Homo sapiens
aaagaatatccttgctgtgccaagaaagaaaagaccatggatctactagttgcagatttcagcagtaatgccaagggggcaagaagtgaccagcagaacaattaggccatggcaacagaagccaactacaacccatgttccaatctatgacctccctctcctgctggtacaaggatatggactagcctagatgatgatggctcaccaatttccttgcaagggcaagagctgataatcaactgactaatgaggattgacttctacaattgatgagcatggaattggatgtgcctaaatcaacagaagagggattttgatgtcatcacactgtagccccagaagacagaacgctcaaaggtgtcaatgggcagaatttgtagatgacatacagcatccaatggattactcctattcagattgttgttttgtttgctagacatgattttaggattttgtcaaggaagccatctatgaccccaatcaatcaaaaccataaggatcaaggctggaagaacctattccttagagcaaaggatgcaatgtcaagcaagttgtgatacctcaactatctacaatttaacaccaaggaaagaacactgtttggagaaatgagaaagattatcatcagtgtctttcagaagtcatcaaaagaagaaaaggagaaaagaga

SEQ ID NO: 52559 - DNA, 470 bp, Homo sapiens
gaaacatgtcttcccagccagcaggtaagcttcagctccttccattcaacaggtaagcttcagtaccaagaggaagtagctctccctgccggcctccgtagccttaaaaagagtggatagaagaagcccagcccacactcagcaatttggcattctagaagtgtagcagatctttctacgaattcttacacatgagcaagctctacccatcttctcagagacccacagatcttccaaagccaagagtttccatcatccaccaaccctcatttcagggagctctgtttttttcatctgcaggccaaaaatgagcatatctgggtcctggcaggacctgagtctcactcatattttcggggccttttcttgtgatgatggcaggtcacttgacgaggaaaagatggtcaataatgaatagttggcaaaggaaaagatcaggaatacattcaaactgacatcttcccagaatg

SEQ ID NO: 52560 - DNA, 665 bp, Homo sapiens
tccatgctgccttttataatttctctccgcttcctgttttctagtgccggcctgattggcttcctcttcatgctgagggctctggtagctgcaaacttcaacaccgtctacatttacacagctgaggtctaccccaccacgatgcgcgctttggggatgggaaccagcggctccctgtgtcgcattggtgcaatggtggcaccatttatatcccaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaaagctatgtctaccagatgagaaaaatgaattctatcttcagaactgcggtgcatttttttaaaacttggttttacttctgtatgctactcggtaattagtaaagtgatttttttttaaaaggcatatatgggaatggggtaggtaactgtatattgatctcttccttgaggaacaatatataaagtacttttataaaatataatttaagctttcaaaggggtgtgagagggagatggtgggggggaagatggcttttcttcgttgaaatcaagtctgtaaacctttatatgaataaatactaaattttaaact

SEQ ID NO: 52561 - DNA, 626 bp, Homo sapiens
ctgggcatcaatttcctgggaagacggctgagcctttctattaccatgggatgcacggctttattcttccttctcctcaacatttgcacttcaagtgccggcctgattggcttcctcttcatgctgagggctctggtagctgcaaacttcaacaccgtctacatttacacagctgaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaaagctatgtctaccagatgagaaaaatgaattctatcttcagaactgcggtgcatttttttaaaacttggttttacttctgtatgctactcggtaattagtaaagtgatttttttttaaaaggcatatatgggaatggggtaggtaactgtatattgatctcttccttgaggaacaatatataaagtacttttataaaatataatttaagctttcaaaggggtgtgagagggagatggtgggggggaagatggcttttcttcgttgaaatcaagtctgtaaacctttatatgaataaatactaaattttaaact

SEQ ID NO: 52562 - DNA, 683 bp, Homo sapiens
  misc_feature (73)..(73): n is a, c, g, or t
tccccccggctcctcgacctcatcaattacattttcatgacatcctgagtatgaatatcaggctctggccgancaaagggtggtgaaggaagacacactgcgtcttgcatttaagcagctccctttattccctccctagcagtgcagctatgacttgcttgtgggtcctggtaggataactcctgggcacctgcattacacagccctaatgcacctatccacttttcctcttatttctacattctcctgtttgttttgagcaatatgtccacaactctgaccttttgagaaatcctttcaatctggaactgactgtgctgcccagaggaaatgtggtttgggctgccggtgagcattggggaaggttgtgtggagggagtcctgtgatgaaatgccctgggtgtgtgtatgtacaacttcctctcaggctattgattttccctgattttagaatgcattttttattcttcctccttttcctggatcctttcacattcaaaaatgtactgaacaaataaatgagatttctttttttctaatttgtttttttgtggagtttcccattatatgtgtagtgataatttttacagtcattctatctagactgacaaaattctttatggaaacttttctctttgcaaggacattttacttctaaaaccaagggggataaaccgaattaa

SEQ ID NO: 52563 - DNA, 440 bp, Homo sapiens
taagaatgcttcctctgaacattatccctagcaatccaataactggatttttgtcttccatccttaccacttcagtttctgctggtctagacatctgggttccaaaagaagaatgcatctcccaggagacatgacaatgattccattcaacaggaagttgagactgccacctgaacactttgggctcctcatgcctctgaatcaacgggcaaagaagagagttatagatcctaaccacccaggagaaattcggtggccactacacaaacagagtaagaggagcatttctatgatgcgggagatcctctagaatgtttgttggtattcccaggtcctgtgattaaagtatgtggaaaactatagcagcccaattcaggatgtttccagatacttcagtaagtgagaactgtgtcactacgccacattgaccagttgagagg

SEQ ID NO: 52564 - DNA, 268 bp, Homo sapiens
ggatcggtgcatagtcaagtcctgccctgtggaaccacctataggaaaagtcagccctccatatatagagcttcacttccctctagtactatatttttcatttgtgtttggttggggaaaaagagccacatgtaagttgactcaggcagttcaaacctgtgtaattcaggggtcacctttgcttacaatgcttagtatgatgaatagctactgtttgttagcatgtctgtctatcccattacatttgaccacttggagggctaaaacc

SEQ ID NO: 52565 - DNA, 1612 bp, Homo sapiens
  misc_feature (1362)..(1362): n is a, c, g, or t
  misc_feature (1468)..(1468): n is a, c, g, or t
ctggtgaatgcaaacaacctgtcaaaggacagaattacagcaaatttaaaagatctcaattggctttctttatgattctggaattgagcaagacatcattccataaaatacagtaattgttccagtgagctgagcagaagaggttagacagaagggctaaagaaagcagaagcaaagaacagagtatattagttacttttcaattagttactttttcttataaggctgggagagggagacagaacaatagaaaaataactggttgattcatatggaggtcagagtggaagcaggtgtgagagggtcccacagaagaaaacatggcagccaaagtgtttgagtccacggtaagtttggcttggccttagctgttgcaggagacctgtgaactctgccttatataatgtggatgttgggcacagagctgtcatctttgactgattccaggacaaaaatgacaggacattgtggtaggggactcactttctcatcccatgggtacagaaaccaattatctttgcctttctccaccacgtaatgtaccaatcatcactggtagcaaagatttacagaatgtcaatatcacactgcgcatcatcttccagcctgttgctagccagcttcctcgcatcttcaccagcatcggagaggactatgatgagcctgtgctgacgtacatcacgaccgagatcctcaagtcagtggtggctcgctttgatgctggagaagttatcactcagagagagctggtctccaggcaggtgagcaacgaccttacggagcaagcagccacatttgggctcatcctggacgacgtgtccttgacatatctgacctttggaaaggagttcacagaagcagtggaagccaaacaggtggctcagcaggaagcagagagggccagatttgtgaaggaaaaggctgagcagcagaaaaaggctgagcagcagaaaaaggttgagcagcagaaaaaggcagccgtgatctctgctgagggcgactccaaggcaaccgagctgattgccaactcactggccaccgcgggggacggcctgatggagctgtgcaagttggaagccgcggaggctctcggaacatgacctacctgccggcggggcagtccgctcctccggctgccccatgagggcccaccctgcctgcacctccgcaggctgactgggccacagccccaatgattcttaacactgccttacccccctaccccagaaatcactgaaatttcataattggcttaaagtgaaggaaataaaagtaaaatcacttcagaactcttaaaaaaaaaagaagaagaagaaaagaaaaaaataaccaattagttgggccaggtggctcatgcctgtnattctagcactttgggaggctaagagagaagagcttgagctcaggagttcaagaccagtctgagcaacatgatgagaccccatctctacaaaaaatttaagaattngccagacatggtggtgcatacctgtagtcccagctacttgggaggctgaggctggaggatcccttgaacccaggaattgaaggcagcagtgagctttgatcacgccactgtaccccatcctgggtgacagagtgagaccccctc

SEQ ID NO: 52566 - DNA, 254 bp, Homo sapiens
atacatttattcataagtgactgactacagaaccttaatagtccacactggattcttcatgttactcccattttctaagggagggaaaggaatgttatgaaatgtattttgaggggaatattctactcttatgttttgagaatcctctgatggctcaatattagaaaatataccaatgtaaaagtattagtgaagtagtaaaactataaagactagttgtcagaaaccagtaataaatagtatcctaaacagtg

SEQ ID NO: 52567 - DNA, 396 bp, Homo sapiens
agccaaatcactgaccctcagaggcctgatgtgaatgcttatggcttcagtccattggattctgcagtaatctgccgatctacagtattaccacagtaaataaccgatagacctgaaaacgaatgcatgccttgtgccaaaattgcaggaaacctcaccaggagaaacaattttatatgagggaatgtactctctcctttgcattttccctcaaatctatatttttagcccctcacttgtctctacagagcctcagttgcttaatctaattgctgactgaacatctccaggaaactgtgtgtacgtgtttgtattcatagtatatttatttattatctgtttacttccatgggatatagtctccataagagagtagtcatcattgtatttgttgat

SEQ ID NO: 52568 - DNA, 664 bp, Homo sapiens
ctcctcacatcacccagtaaggaaataagcactgttatgttccccattttacccatgaagcagctaaggattaaagttaaggaacttccccaaagtcatccacacctagtaaacagagcctagacttaaaccagggcagtctgataccaagacccacaccctcaaataggtatgttagtgccagaatcaaatacatcaattccagaaactagcgggaacactgacggtgatttttcagatttctcaaatttagtgtgttccaaaaggaacccttgcctcctccttccgccaacatatactccatttcaagaaagggccccaccatcctccagtctctcgtccagtatgctctcacttaggtaagcgctacgaggacaaggctctatttactttctacctagctaagaccttacacaaagcagatgctcatatttattgaaggaataaatgagggtaagagtggggtgttgatggcgcccctgccactgagaaaagaggagctggggtagagaagtggtcattcctaactggggatggtcaggagagccggatgctaggtattcctaaagcttccaaggtgaaaggagaaacaactcacgccaaggtatctagcttcttactctgcaagaatgaggccataaaacccaatgagggaagggagaac

SEQ ID NO: 52569 - DNA, 406 bp, Homo sapiens
gtcaggagattgagaccatcctggataacatggtgaaaccccgtctctactaaaaatacaaaaaattagccaggcgcggcggagggtgcctatagtcccagctactcaggaggctaaggcaggagaatggcacgagcccgggaggcggagcttgcagtgagtgctaccgcactccagcctgggtgacagagcgagactccgtctcaaaaaaaaaccaaaaaaacaaaaaacaaaacaaaaacataaagcaatacactgtagtgacagctatgtctgtgctacaatatccagtgccttttcaagcagatgcaaaagcaatgattctccaagtggaatccccagccaacagcatgagcatcactttggaacttagtagaaatgtaaattttcaggccccagcctggag

SEQ ID NO: 52570 - DNA, 338 bp, Homo sapiens
cctttattatcaacaaagagtgtcccagaaaactcttaatacttaaataaatgaaaatattcagaaatgggatgactaaatataaaattccttttctatattggcctgataagaagtgctatgccagttttcctctagataagcattaactatctataaatcatttagcaaaaagaaatcttacctcttaaagtcattattcataaaaagaaaaagaaagaccatagtatggtgcctgcttgccttttagtagatccaaacttaaaatacagagcacgtggccgatgccacgagcaacataagacgccaccagcagctaacatcacagcacttaatta

SEQ ID NO: 52571 - DNA, 184 bp, Homo sapiens
gtcttcaaaatactggactacatgcatgacccattgtgactggtctcatgctttttgatgaatttaaaattttccctgtataggtaactgaaactttgaaacaaaaaatgcagttttaggtttccggaattccagtctgagtcgtccgtgttcgctacccactaaccagtttggttctggtgat

SEQ ID NO: 52572 - DNA, 98 bp, Homo sapiens
aataataatgaaagtggttaaacttgccaaagaagagaagagagaaggaagactatttgtacaaccctgggaaggcctccacatttactaagttaaag

SEQ ID NO: 52573 - DNA, 164 bp, Homo sapiens
taacagcctaatctttttgggtctttgaaaaatgctaggaactgttctgtaactgtcattgatttaattctcacaatagtttgatgaggtaggaactactactagtttcgttttacagacatagaatcttgccgtaatcctggacattcctatagcagatggtt

SEQ ID NO: 52574 - DNA, 623 bp, Homo sapiens
aatgctttgttttgcttgaaatcaccatatttaatacagggggtaaaatgttttccccactagtgagcatgggcttaaaaaggtagagacacactgctctgggtatttttggtcaagcatgagtcgctcagctgggttctctattcctggatacctgcaggtggtgctatggtaaatgcacagcattgaggttgcttcattccggactcaggctaagcctggcttttaaacaacggtctcatcattcacagccactcagtccccttcttcacacagagctttcagattggtcaaccttgaagtaataaccaacaaggatgatgaaaccatgatcatactttcccagcttatggaaggggcctttcagagggctgctgaagtcagcacacagagtcactgtagctgctgaaatgctgttactttaatatatctcgtttggtgtaccgttttgtacggaattagtcactgttatgtgggaaggtgcaactgaaaatgcaagtagctgtccttagcgaggatgctcacagtgggccaacagacccaggagggcttgacacagaatgccagggtttgaagcagaatggcagaacaggacatcaagccagagctacaccaggctgact

SEQ ID NO: 52575 - DNA, 457 bp, Homo sapiens
ccttaatctccttattctggttcctaggaaggcatggaggaaactctcctgcaggcatccccagtggggtatctgccctatctatttcaagagtgaggccaatggaaggttttctctcatgcagggtgtagagttggaagaccacacaggggcaggtgtgagatcatcttgtaagaaaacaagcttctcccttgtcacctggagaaacttttgcaaatcaatttgccatctattaatttgccatcacacttcatataaaaaaagcatcttctgtgggttaatagggcatcagtgggcatcattagagagaagttgggtgtgtgagtagcactcatgaacccaggactatctctgtatagaacacaagaagtaatttgttagcaaaaccttttgcagcatcttgtaacagagagcaatgatagtgcaagatggaaaatccaggaaaagcagtttcaca

SEQ ID NO: 52576 - DNA, 1080 bp, Homo sapiens
tgtaataagagcggggtctccgcggggaaggcgcccacagcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggttatcatgaaactgaactcaccatttctattaatttctgttggtaagaacttggtgagaatgccccgtggaagatacacatgtttgcatcctaagatactgaaaaaagggcacctttgtcacttgaaaggaatgaaactgaatgcaaaataagctaattccatatttgctgtgcatcatttttatatttaattctatgtccagtaaaagtgatggcatctctcattgacttatctggtagcaaactggttctttcggagccatcctgttgatcatgcagctccaccaaaccttagggggacgtgaaatcactgcctgttgtggtctccgaggacacatggtaatggtgatgctgtgccttgttatctaagaacatgattgtataatttgtttaagaaaatgtcaatattgtgccatttgtgaacttcatcaagattaaaagcatattttgggtacatttgtttcaaaaccttggtgatgcattacaacttgttttcttatgtaataataatgatgatgatgatgataataataaatatttttgagtgcttactatgta

SEQ ID NO: 52577 - DNA, 2100 bp, Homo sapiens
  misc_feature (1687)..(1687): n is a, c, g, or t
  misc_feature (2099)..(2100): n is a, c, g, or t
tgtaataagagcggggtctccgcggggaaggcgcccacagcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggtgtgtcctaaatccaatgacatatccttataagagattcactcagaagacacatgtggagaaggtgacatgacagaggcaaggaggcacaagccaaggaagtctgtgtctaccagaagccagaatcacagaacagtctctggaagaagagcagccctgctgacacctagagtttggacttccagcttccagaactgtgagagaataatttctgttgttttaagccacaaagtttgtggtaatttgttatgacagccctaggaaactaatacaatacattttcatttattttgggtaaatgccttggagtgggattgctgggttatttggaaagtgtgtatttaactctgtaagaaactgccaaactattttctgaagtgactgtaccacttcgccttcttgccagccacatatgagagctctagtatttccacaaataggtatgtagcagtatctcattgctgttttaatttgtatttccccaatgactaatgacgttgagcatctattttaccatatgtttatcacctttattgaagggtctgtttaaatcttctgctaaatttttgttggcttgcttgctttattagtgttgagtttttagagctctttatatgttgtggatgcaagattgttttcagatatatagtttggaaacttccttcccctgaatctgcggattgctttttcattttcttagcagtgtctctcacagagaaaaagttgtaatttgaataagatccaattcatctttttttttcttttatgtattgtgcttttagttcatgtctaagaactctttgcctaactaaggtcccaaggtcacaataaccttattctatactttcttgtaaaagttttatagttttatattttatatgtagattagtgatctattttgagttaatttttgtataaggtgagaggtgtaggttgaaattcatacctgtgaatatagatacccaattgtttcagtgccatttgttaaaaagactgttatttcaccatttaattgcccctgcacctttgtcaaaaagcaactgatcatatttgtgtgggtatatttctgggttctcaattctgtctcattgattgatttgaccattcttttgccaatgtcatactgccttgattagtgtagtgttaaagtgaatctcaaaaccagntaatgtgggtctaccaacattgttcattcttgttcaaaaagattttagctacatctaaaatattttctacatcttttatacattttagaatcagtgtgttactatctacaaaatttctgatgagatttttaatgggattgtgttaaatcagtgggttaattttgggagaattagcatattaataatattaagtcgttcaattcatgaacacaatacatgttttcacttatttaggttttctctgtttttttttttttaacagtgttctcagttttcaacagaaatattctacacatatcttgttagatttttaactattttattttttggtgctaatgtaaatggtacttaaacatttttgtttttaattgttcattgctagtagatagaaatacaatatttaaaatattann

SEQ ID NO: 52578 - DNA, 286 bp, Homo sapiens
ctcaaactcctgacctcaggtgatccggagcctcggccccccaaaatgctgggattacaggcgtgagccatggtgccctgcccccatctttaaataaaaggaaaattttagttgaaattttgttcagtattcagagtctgatttacaaatcgattttctatccctttcctgtttttttgggggggtacatttctattttaccttcatttttcatcttttgaagtctactatttagtacagtgtaatgtggctgggtgtggtggctcacacctgtaatcctggcact

SEQ ID NO: 52579 - DNA, 489 bp, Homo sapiens
atcaaggaaattgtaaaggagactcctgccctggataggaggtagctgagcaggtaaagtgaagcccagagagaggaaggaactgtccagagggtccatggtgcattgagggcaggaccagatctctgtctgcagagtcttagaggcatcatgaacgtggaggaaagtgacatgcaggtcactcttggcctgagtcaccacttgaattaacagctttgcatattctacctagtgtttcctcgcccagaccaaggcctcagatttgtaaagtggggggtggacaattgttaggcagtagggggttggaattcccttttgcaggccgggctgtgtgagccataaacatttgtcatagaaaccctggatttacagggacaaagagccctgagcacaggaacaaatggactcaaggcccataactcctctccatcaatcttttcttctggattgtgcaagactctggcgattgcatacagcggctcctggcag

SEQ ID NO: 52580 - DNA, 285 bp, Homo sapiens
acacaacgggaaggacaggcactgacgcacataaagatgaggaggctgagcgtggttccaggcaccactgcggtatagaaagtggcacctagagccagccaaggacataaagatggacttggagacactggagcagtgtgggtgcccctcagcccaggaatgttgcagagaggagtcatatgtgagattagggttgccccaagttacctctaagttctgtccaactcaactactctgtgagtctgtgacagtccctagctctgtgtcctaggacacagtgacacc

SEQ ID NO: 52581 - DNA, 418 bp, Homo sapiens
taccaattataaagataaaattataaatatttaaactgatttagatagcaggaatacttgatatttatatttctttctacctttcttcatattgtctatcattttaaaagtatgtaaattgggcgggttgcagtggtttatgcctgtaatcccagcactttgggaggctgaggcagtagaatcgcttgacaccaagagttgaagacgagcctggacaagatactgaggcctctatctctacagaaaataataataaaatttaaaaaattagttgggcataggagcacatgcctgtagtcctagctactccagaggctttggcaggaggatttcttgagcctggggtttggaggctgcagtgaactatgattccaccgcaggagtccagcctggggaacagagcaggatgcagtctctt

SEQ ID NO: 52582 - DNA, 570 bp, Homo sapiens
gcagcatctataagctaggaaggaggccctcaccagacttggaatctgctggcttcctgatcttggcctttctagcctccagaactgaacatggatgaagctggaggccattatccttagcaaactaacacaagaacagaaaaccaaataccgcatgttcttccttataagtgggagctacatgatgagatgagaacattgcccaaaggaaccaagtgaaattaccaaattagaagtgataagaggttgactctctccagaaatttattgtaattagaaagaggtaatggtgtctaaataagatgaaagaagatattttaaagatgataataacaaaaactactagaatgaggtgaagccagaaaggaagagtcataatcaaagaagagagtgatcaagaatccaaaatagacagagagagcaggctcttagagaaatgggagaactaccgcactgactctgcacgtaggagacaggcaggagaggagcgccccagccagagctcaacatgcgcaaacaggaagtgtgtccgaggttttctggagctcacaggagccggggacccacagc

SEQ ID NO: 52583 - DNA, 406 bp, Homo sapiens
attacaactgggggcaaggacattaagtttttggtcgatactggtgctgaacattcagtagtgaccccccaggtcacccccttatccaagaaaaccattgatataatctgagcaacaggagtttccactaagcaggctttctgtctaccacagacctgctcggtggggggatatgaaatagttcactagttcttgtatatgcctgactgtcccttgcccctgctgggaagagacttgcttagcaagctaagagccaccatctcctttacaaaacagggctctttacagctaaagttaccgggaacaggagttatcatggcccttacggtcccctgggaagaagaatggagactttttctaactgagccaggacaagagataaaaccagctctagctaagcgatggc

SEQ ID NO: 52584 - DNA, 353 bp, Homo sapiens
tgtacttccaactctgtaaaagaaagcacactattatgcttcagacataggcccatagtgagtgtaatagtatcccgtcaccatataaaatgtaagtgaggaacattctagaactttttcttcccatttaagctttttatatggaattttgtatctccattgaatggtctaatatgtaaattacacctaccacacctttactctttatatccagttttcatgagctaaaacaataaattccagtggagagttttatagagatttagaagccacccttgggaacaaaatgtagcttgccttagttgttatacaagcaggtgtatcatcagttttagagggagtcttttagaact

SEQ ID NO: 52585 - DNA, 280 bp, Homo sapiens
aatttatgggaaaaattctaaaatactttttataatgaaggacaacatcataactccctaataaaatgtgcatgtatatattcaaatttgctgtcattgatcctgcacctacaaaatccagtcctgggggctggcattcttactgcttgctgagggccagatgatatagattccagaatatctccatgtagattttggtgagaattactgtgctgaaaagaatgacagtattgcagttatacatgggggttttggtactttatattgtgactctgaattt

SEQ ID NO: 52586 - DNA, 527 bp, Homo sapiens
aacttaatgtaaaagtgcatacttggttacacttttaccaaacacataatcaatttattttctatttcagaaggcattattgtgtaagtgggtttaagggtgggtctggtatgattttagtaagcatgtttggacttagtactgtctgtgaagtgtaagtagttattgtactgaaataatctagggccctacagtgctgatgacgtcgtctcatggagtgtgtgggtgtgtgttccatacctgttatgtcggaaggcactctcatggcaggcccatttggctctttgactttgggaactaaccaggcacatctttatcattactgatttctgcagtttcaggaagttgagggtgcttgctgcttggaggccttcctcgacatatcaaaggctggctgggcgtggtggctcacacctgtaatcccagctttttgggaggccaaggtgggtggattgcctgagctcaggagttctagaccagcccggccaacatggtgaaacctcatctctacaaaaaaaaacaaacaa

SEQ ID NO: 52587 - DNA, 546 bp, Homo sapiens
ctggtaatacagtgttggccgccaaggtccctgggaaccaggctgctgttcagcgcattgtccagcccagccgaccagtaaagcagctggtcctccagccagttaagggttcagctcctgctggaaaccctggggccacagggcccccactgaagcctgcagttacactgacctctacacctacccagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggacaggacaaagcccaggacaaagactttcagtaccagtcaaggtggt

SEQ ID NO: 52588 - DNA, 691 bp, Homo sapiens
acctcccaggagcaagggaccaccaggttgcctaaggagggatgaattggcccaggttggaaacggagcaggcagcacttcccttgctgatcagcagtagtgttgtgcctgtgaatagccactgcactctagcctgggcaatacagcgagaccctgtctaaaaataacaaaaaagattgcatcaagacagataggatgatgaacaaagtgagttgtactgtgtcttctgacctgtagtttttatgattctagcatgaagaaaactggtgtaaatatttcagagtataccattctttaatgttgtactcttgcaatttcctttcttcactttagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggacaggacaaagcccaggacaaagactttcagtaccagtcaaggtggt

SEQ ID NO: 52589 - DNA, 668 bp, Homo sapiens
agggtgagttgaaacgctgcctggaaaggaagtaccaggacttgcacaggagttccaccatcttcctctgaagacgtagccatcttgctccatgaaggtcaggacaatctgacatgcacttgtttcttgcctctatacttgaagagtagtccccttccctccctagaccttggagaagtaccctccattactttcccaagatggcagaccccatcatggatctgttcgatgacccaaatttatttggcctggactctctgactgatgacagctttaaccaggtcacacaagaccccattgaggaagcccttggactgccaagctctctggactccttggatcagatgaaccaggatggtggaggtggtgatgtggggaattcatcagcaagtgaactggtccctccaccagaggaaacagctcccacagaactttccaaagaatccacagctccagctccagaatccataaccttgcatgattataccactcagcctgccagccaggagcagccagcccaacctgtcttacagacatcgacgccaacatcaggacttttgcaagtctccaagagccaggagatcctgagccaagggaatcctttcatgggtgtctctgccacagctgtctcctccagtagtgctggagggcagccacctcagtcagcc

SEQ ID NO: 52590 - DNA, 455 bp, Homo sapiens
agggtgagttgaaacgctgcctggaaaggaagtaccaggacttgcacaggagttccaccatcttcctctgaagacgtagccatcttgctccatgaagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggacaggacaaagcccaggacaaagactttcagtaccagtcaaggtggt

SEQ ID NO: 52591 - DNA, 407 bp, Homo sapiens
taaactcccactttagataacctaaactacttcataaaagggaacaaaagcttaatacttgctatcagaggtatggcaaaagaatccttttcttcacaattagtttccaatttctgtcaaaaccagcaccctaccctctactgataatcagacttctggcagtagctcacacctgtaactccaacattcagaggccgaggcaggtggatcacttgagttcaggagtctgagatcagcctgggcaacatggtgaaaccctgtctctacaaaaaaatacaaaacttagccagacttggtggcatgtacctgtggtaccagctactcaggaggcggaggcaggaggatcgcttgagccctggaggcggaagttgcagtgagctgtaaattgcaccattgcacttcagctt

SEQ ID NO: 52592 - DNA, 306 bp, Homo sapiens
ctacttaggtggagacacgcatagaacctcacacactcaagacctccccatggcataccaaagaaccagtaacttacaagaaccgaaagagcaccgatgcacttgagattttctaagtcttcatttgattgtttttgtagagacttattctactggaagtatatgaatactaactcaatgacaagtcattaaactcgaactttataaaaatatgattctaagggccacaatgtccaacttcagtataaagacctctctaaaatattgaaagcaggtatctccaaatgtaaatatttcactagccac

SEQ ID NO: 52593 - DNA, 364 bp, Homo sapiens
gtcagcgaggtactaggagctcaggacactgaagtcacaaggcaccggcagcaacactgacacaatgctcaatgcctcccatataaggctactgagattaggtttgatcttagagtctgggacagatctcagcctgctaatctgagtaacgttggtgtggctgccaggctgctagacagagaaccaagtaggtaatttcaggtccataggcttgtgcaagtcagaggatagggcgtgtctacaaaggggaattagcaatgcagggcagcagcttactgacttccaaatggatgacaacattctagaagagatgtgacttagctgaactctgaagccagattcctcctttgtgggtatgtactca

SEQ ID NO: 52594 - DNA, 230 bp, Homo sapiens
agtacctgagggacatccttctccattcaggacctgaggatgtccttctctgtactcccttgggactgcaccctttcctgtgccatccttcagaatgctaggctgtcgctggttgtggattgaactctagcatcttatctctattctaggtgaatcccttcacatttatagtgatttaccatttaatcactgtgccattttccccaaaatatgtggggtttggggtttgg

SEQ ID NO: 52595 - DNA, 265 bp, Homo sapiens
gacaaaaaataggagtaatgccaagaaggtggttcataacttttttcaactatgttctgtagaatatttaaatatcccatattcttttctttttatttcaatattttttgtagagagtggggccttgctgtattgcccgggctggtcttgaacccctggcctcaagcagtcctcccaccttggcctcccaaagcattgggattataggtgtgagccaccactcccagccaattatcctatattcatatgatcaaagatgagtgtg

SEQ ID NO: 52596 - DNA, 285 bp, Homo sapiens
gcgcccaccaccatgcccagctaatttttatatttttagttagagacagcatttcactgtgttggccaggctggtctcaaactcctgacttcgtgatccacctgcctcggcctcccaaagtggtgggattacaagcatcagccaccgcgcctggcccactgctgactactagagttactcttcccttctctgaatttgcgatgtatttgtgattggccttctgttcctttgcacctgatcatatatttgctggtaatgttctctacacagtaatatgtctcctca

SEQ ID NO: 52597 - DNA, 369 bp, Homo sapiens
gtgagtggcctgtgtcatagtgggatgtctgactggtcggagcaaaggtacccaatcctccagcctgaccatgagctgggtggtgaactagccagccacaaacaagccagatgggcagacagaccaaaatagccacttgtccacctccttcctggaaatgcagaagggctgctccggaggtccaagaagacctaatttggtcagcaacccagcacttactctgaacaggaggtggagttgtgagcctggtataagttccctacctccgattctttacttttaccacacacgtttgcacatttcaaggagatgatcagccacactaccaactactgatgggtaacaaatactctttacgtcaaagctctt

SEQ ID NO: 52598 - DNA, 567 bp, Homo sapiens
  misc_feature (484)..(484): n is a, c, g, or t
  misc_feature (524)..(524): n is a, c, g, or t
cgcatcttgctcccatcaggtgcataaaaatcatttgacaaaataattgtccattcatgatttaaaaaaaacaaaactcagccaagcatagtggcgtgtgcctataatcccagctactcaggacgctgagggaggagaatcgcttgagcacaggaggcagaggttgcagtgagccaagagtgcgcctttgcactccagcctgggcaacagagcaagactccgtctcaaaaagggagttggagagagtaaatagaaaaaagatttatggctattggaatgtgctttcactggctttaaggattttataggatagtaagagggtaaagcactgttacaggcgtacctctgaacctgtttactgtaagtcagtttttataaattaaataattaaaaatgtattagggaacaccatagaacatggctgaaagaaattgtaaaagacctaaatgattacgggtgtgagccaccatgcctggccattctnaagatcaaatggctactaagttggtggctcaaggactgancctagacagttggaaccatataggttttgctcttattaatcgc

SEQ ID NO: 52599 - DNA, 1081 bp, Homo sapiens
cgcatcttgctcccatcaggtgcataaaaatcatttgacaaaataattgtccattcatgatttaaaaaaaacaaaactcagccaagcatagtggcgtgtgcctataatcccagctactcaggacgctgagggaggagaatcgcttgagcacaggaggcagaggttgcagtgagccaagagtgcgcctttgcactccagcctgggcaacagagcaagactccgtctcaaaaagggagttggagagagtaaatagaaaaaagatttatggctattggaatgtgctttcactggctttaaggattttataggatagtaagagggtaaagcactgttacaggcgtacctctgaacctgtttactgtaagtcagtttttataaattaaataattaaaaatgtattagggaacaccatagaacatggctgaaagaaattgtaaaagacctaaatgaggccgggtgcagtggcttatgcctgtaatcccagcactttgggaggccgaggtgggcagatcacctgaggtcaggagttcaagaccagccttaccaacaggaagaaaccccacctttactaaaaatacaaaattagcagggtatagtggcacatgcctgtaatcccagctactctggaggctgagacaggagaatcacctgaacccggggatggaggttgcggtgacccgagattgcaccattgcactccagcctgggcaacaagagtgagactgtatcaaaaaaaaaaaaaaaaaccctaaatgaaagacctctcatattcatggattggaagacttaatattgttgaatattaatattgttaatatacttcccaaaataagctatagatctaatataatccctatcaaaattccaactggctttttctcagaaatttattaagctgatgttaaaattcatatggaaatgcaagggatatagaatagccaaaacaatatttaaaagtagcaaaagtttggagaactcacattcctgatttcaaaacttactacagagctacagtaaacaagactgtgcttctgtcatgaggatacgtataaagactgatagagtagaattgagagtccag

SEQ ID NO: 52600 - DNA, 378 bp, Homo sapiens
gtggacatatccaaatgtgcttctgtttcctgcagtttcactgaccatgagctttctcctctcaacattgacatttcaagtcagatagccagtgtcaagaggtgccattgtgacagtgtgcatacatatttaattggatggctacatttcacatcagcttaaatggaaaagaaaacagagtgactttaccctaagccagtatttcccagtggctatggtgtcagtttccccaagaggctactaaagggcaagtatattttgttttcacatactctaataagcaacacgtttctttactaccaaaaaagttcagtactgctgaatggaccctcagatctgcagtcaggccaagaggcaaagctaaccagggacactgcc

SEQ ID NO: 52601 - DNA, 679 bp, Homo sapiens
ccagcttggattataaagtccatgctggctatttgtagaacagcagttctcaaaagctgctagacctgctgaatcaaactgttgtgttttgacaagctctccagaattctgatgcaggctaaagcttgagaactattgatgtagaggaatagaaaagaatatttcctcactgaaagtcacatactcttttgtaagggtccaaggcagaggcaaggaaagcctcaggaggggtctgtgtcagaaagcactggtcacaggcaggagtgactggcacacttttggtgtgttccagggagaccccttgggacctcccagtcagcatggcatggcatgggcatgggccaggctacactgtgtctgcatcataccacatctcacccagcttgtgtgggatgtagctaaccgttgttggagacagctgcctgggcatgcagcccggctgcagctacagaagccctgccccagggctagctcagctaggcagaacatcgggccacctgacaactgctgtttgcagtagctccacaggccctcagcccagcccagctccctgtgcacgtgtgaggctgagacaggcaagagggcacctcactgtagggaccttggagctggcagagcatggtcttgggattcacatgcaaaatgcaacttctcacagctcctctcagcaccctgcagc

SEQ ID NO: 52602 - DNA, 417 bp, Homo sapiens
tttgcaaaactgataataaaaatccaaattatagatcatatttatcttacatttattgtgctaagggctttgtattatttaatttatttagcctgcagaagtatgctctgaggagataaacatgaccatttatagaggtcacaggctagcgagtcctggatctactgattaatctcgctctgtctttgcagccctgagaggataagtgctttccaaagcagaggagcagtaaaggctgagcccgggaggcagaaacaacattggtccatgcaccataaaatgtaagcgccatgaaagaagacactgttatattcacttctccattcccagcacctaaaaaagccactaaaacatgataaaggtcaggaaatatgtgaggaaggaaggaactcacagagggagatgggtttggaaaaa

SEQ ID NO: 52603 - DNA, 349 bp, Homo sapiens
aaaagctatttgatttttactcagtttctcagtgggtaggagagtgtcatatattaaaacttggggccaggtgtggtggctcatgcctgtaatgccagcactttgggaggccaagccagaaggatcacttgaggtcaggagttcgagaccagcctgggcaacacggtgaaaccctgtctccactaaaaagacaaaaagcttagccgggtatggtgacacacacctatagtcccacccacttgagaggctgaggtgggaggatcgcttgaacccaggaggctgaggttgcagtgagctgagatcgtgccactgcactccaccctgggcgacagagtgagacttcatcttg

SEQ ID NO: 52604 - DNA, 449 bp, Homo sapiens
ctagcaggtttttaaaagacacggattatgtcttttagatggccaggaaaatacattattcaagtatttggagcattttaggaatacaaactaccaaataagacataaaattcagcattcccaccagacacatagggaactttttttctttttttaacagactgttgcctcctccaactcccttaggatgccgtgaacaatcactttctctgctacagccttagaacatgagcagacacagcacaaaaacagggcagtccaccagtggtttggcagcttaagtatccatcatcaacttttctggactttcttgaaaagtagttgccattcctgactagtggttttactcatttctattggaaactaaaatctgggtgggctggaatcctcaagagcatgttaagaagccagataaatcaatgtccccatggtataactaatcctaaaag

SEQ ID NO: 52605 - DNA, 697 bp, Homo sapiens
ctctctgccaaattctattttgcctgttagaaatattgctgcataagctttcttttaattgcgacttgtctggtatatctggaaacctgaatttaaatcctggctctgattttaactcgttatgcattaggtggaaggctgagacaagccactcaaccacaatttccttactggtgagattaaaatgctgggctggacagatcccaacacctccagctctgacatcctgttagcagcctgttcagcagtcaccacaggggctggttagcacctcctccctggcccttctcagccctgcagcaccaacctcctaccagagatgtctgcatggggtggtgtagtcatatattcttttctttgtaaggttaaactcctctgaaatggaactgggggaaactgtcttctacagcaggctcagggatctcctccttgacattatctagtcctcagtttcaacatattttattttctgactaatcttgtcttgatatggggggaaatcaaatttaccatgaagctccccagtttctgttagctcagtttgaacctctcctttaggttttaccaggctctttaaggcacagactgagtcttctgcagacactctagctatcagagacgctcctgtcttccgagcagccggctcacccatttctctgtcccaaatggcatctaggtgcagggaggcacatcccag

SEQ ID NO: 52606 - DNA, 207 bp, Homo sapiens
cgaggtagcaactaagtggctggaagagcatgttccagctgattatcagaacccccaagagtatgtgaggatccagctaccaggaactgacccttaataggatccaaacgagacagagggtatgcaaaggctaatgcggtatagggaagcactcttagaagggttgaggagaggagcccaaaaggccacaaacgtaaacaaggtctc

SEQ ID NO: 52607 - DNA, 6972 bp, Homo sapiens
cgcccccgcctctgagctcccttcccatggcggccctagtgttggaggacgggtcggtcctgcggggccagccctttggggccgccgtgtcgactgccggggaagtggtgtttcaaaccggcatggtcggctaccccgaggccctcactgatccctcctacaaggcacagatcttagtgctcacctatcctctgatcggcaactatggcatccccccagatgaaatggatgagttcggtctctgcaagtggtttgaatcctcgggcatccacgtagcagcactggtagtgggagagtgctgtcctactcccagccactggagtgccacccgcaccctgcatgagtggctgcagcagcatggcatccctggcttgcaaggagtagacactcgggagctgaccaagaagttgcgggaacaggggtctctgctggggaagctggtccagaatggaacagaaccttcatccctgccattcttggaccccaatgcccgccccctggtaccagaggtctccattaagactccacgggtattcaatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 52608 - DNA, 170 bp, Homo sapiens
gcggccgcctactactactactgctcgaattcaagcttctaacgatgtacggggacatgggggtggggcctcagatgctggggcccagtctgccccatcttcattcctgcaccttaaacctgtacagtcatttttctactgacttaataaacagccgagctgtcccttga

SEQ ID NO: 52609 - DNA, 6484 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 52610 - DNA, 3387 bp, Homo sapiens
ttagacggaccggcctccggttaaggtgagcgaccttcaatctgcatctcattgcggaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 52611 - DNA, 3043 bp, Homo sapiens
taaggctaggtagaggctggtgttaatcggccgaggagaatatctgctgtcattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 52612 - DNA, 6640 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttgatgctgagtgtagtagaacagagctttcttttagaaaattgagcagattcccaaattataagagcagcctcaccaggcagggctctggctagggctgcgtgcccacactcggcattttcacactcgtgactctttgggactcggcaggagcgtgtta

SEQ ID NO: 52613 - DNA, 2828 bp, Homo sapiens
tagtcttgggagacccactcacagcaggcgctggccgtgccgtcctcacacagcgatgcctggtcctcgcgggaggacagagtttcactcgtaggtagaagctcagcccagcaggtgctcagtggagacaccgtctcccaaatcaggttttgttgtgtgtgggttttgttcaagtgtgacttctgtctttaaggagtgttaaggccagctcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 52614 - DNA, 6421 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccaaagcttaagctttggtcaggctggtctcaaactccctacctcaggtgatctgcccacctcagcctcccaaaatgctgggata

SEQ ID NO: 52615 - DNA, 5155 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgtgttcctccgcccaggagctg

SEQ ID NO: 52616 - DNA, 5157 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgccaggcgtggtggtgcacatctgtaatcccagctacttgggaggctgaggcaggagaattgcttgaacccagaaggtcacgccactgcactccagcctgagcgacagaacgagactccgtctc

SEQ ID NO: 52617 - DNA, 3848 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtgcaggaactctggcaacctaccccactgctgcccttccccaagggggtgaaaatactgcaccaaagaattatctgggctgggcacggtggcatatacctgtagtcccagatactcaggaggctaaggcaggagaatctcttgagcccaggaggtagaggctgcagtgagctgcgagtgtgcagtgagtgcaccactgcactccagcttgggaaacagtgagatgctgtctcaaa

SEQ ID NO: 52618 - DNA, 637 bp, Homo sapiens
tgcccttctccaaggcccactggacaccttttgaagggcagaaagtgaagggcaccgtccgccgtgtggtcctgcgaggggaggttgcctatatcgatgggcaggtacgcaagtagcccctgcctgatctcagtagtgccctcttctgcaccacgttcatttcttcccttcccagcacatctacactgtcccactatgtgcaccactgccctggaccaggggttggggcacagctcccccaaggtgctttttgtccttgctgacatctacccctttaggacctgagttctctctgctccctcctgagtgccctgccttctgcctgcaggttctggtacccccgggctatggacaggatgtacggaagtggccacagggggctgttcctcagctcccaccctcagcccctgccactagtgagatgaccacggtatccacactactgggctagggggctgggaggtgttagtctcagggcaggatgaacagcttgaacattttcattggtggttcaggaacaattggggttttcttgagggactgaatttgaagtggggttgggtcaattatttttttaaaatgctgggccaggccagatgtggtggctcacacttgtaatcccagcactttgggaggc

SEQ ID NO: 52619 - DNA, 6573 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgaggtgggctgggacctggtgggttacccggaggctggatgatgcttgggggaaagtgtgaacaactcagctaagctccctgcctcctgtagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 52620 - DNA, 6728 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggaggtaagagtacacctgagatcctgctgtccctgttgctttcccagtaacaccaaaggtcagggtagtccttaggggcaggagacagcaggaggagagtctggagacagcaggaggagggtctcgagccagcacccttgcaggtctacatcatcatttttttgagcagggatgttggccattgggactttgtgtagggcaaggcatatgggtggtgcctcttctggatcttcccattgttccccagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 52621 - DNA, 6844 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttgaaaaaaaaaaaaaaaaaaaaaaaaaaaaatttttgggccccctggcccccaaaagagcttttttaggacgcatttctcgtgtggggccgcgcgcgggcccccttgtgttctaggtggaaacttgggcccttaagctctggttcccctagaggaagactcctcgggctactggcactagagtgcgccgtggtgtttcctccccctattaaaaaaaagccccgggggggaaaaccgcggagcgtttttcggaaccacttcccagtatgggggagttccagaaggtccctaaagggggagttctatcacgccgggtgtcccaggggagtcccgatatatatttagcgcgcgccgggggggcggg

SEQ ID NO: 52622 - DNA, 1306 bp, Homo sapiens
ccacgcgtccgcggacgcgtgggctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 52623 - DNA, 5314 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcctccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacggtatccacactactgggctagggggctgggaggtgttagtctcagggcaggatgaacagcttgaacattttcattggtggttcaggaacaattggggttttcttgagggactgaatttgaagtggggttgggtcaattatttttttaaaatgctgggccaggccagatgtggtggctcacacttgtaatcccagcactttgggaggccaaggcaggcggatcatctgaggtcaggagtttaagaccagcctagccaacatggtgaaaccccatctctact

SEQ ID NO: 52624 - DNA, 3556 bp, Homo sapiens
ctgccgggtcgacgtctagaggagtccccagtatgtgtaacaacgacctatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaacagtggagaccattgagctgaccgaggatcgacgggcctttgctgccagaatggcagagatcggagagcatgtggccccgagcgaggcaggaaattctcttgaacaggcccaggcagccgctgaacggctggggtaccctgtgctagtgcgtgcagcctttgccgtgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaaaccaaccctgccaacaccttgatcttggacttccagcctccaaaactatgagaaataaatttctattgtttaagtca

SEQ ID NO: 52625 - DNA, 7193 bp, Homo sapiens
  misc_feature (3216)..(3216): n is a, c, g, or t
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacgtaaggccagcagcagcggggcctgggcccctgggccctgcccagaaactgcaggggcgggggtggcggggtgaagccatactcgctgtttcctctcgtccacccagggagcactctggcgaatgcatttcctgttctgttctttccttttgcaagaagcgatggatgtggggagaaaaaggaatgaggcccgtttgctccttgtgtccgggagggtgaggagaatccagaggaagcgggcctgggtcggccgcaggcacagcctggaactctgccccagtgggccctgtctgggaccgtgggcttctcctcccacacattaccttccagagctcagggcctccccagcacctcctcatttccctttagagccagctctctatcctgacccaggagtcttggcatgaattgcctctggagaggcttgtgaatatggtctaagtttgtttcctttgtttatttcatcaaacactttttgattgcatactgggcaccagctcccaggaggcaaaggccctagctgcctagctcttgatgactagtggggcagacagatgggctctgcaacagtgtgggagtaaattgaaggtgggttgagcttctgaggacagttggaagccatgtcgaggctctaacatgaaatattggggtctgggtgtggggaccaccttgaatttttgttttatcacacagttggtaatgcagaggctcccctctgccatatcctgaagacagacatcatagggttagatcctcaaatgcacgagacggctttttccaaaactcagttaatgtcactttattaaccagcgaaatagataataaaaaagaaatgaggtgaacacattggacaaaaccattacttgccagtgacatgattctctacctggagaactcaagagaataacttgaaaagctattagaatgaataataagcatgtacataacagtgttgcttggaaatcagtgtgtaaaaatcaatcactttcctatagatgagtcgtaattatggaaccatttttttcaatccacaataatgaaaagtgcttataaaaatagctaagagtaaacttcagagaagctgcctcagtctgctcaggtgggcggcagagattgctggcccggggactttagatggcctcctcagagtaggaaggtcatttgcagcctggggccctgctcaggcctgggattctcttttttattgttttattttatttatttgtatgtgtgtgtgatggagtttcactcttgtcacccaggatggagtgcagtgacgcagtctcagctcactgcaaccaacaccttccaggctcaaacaattctcctgcctcagcctcccgagcagctggcattacagatgcctgccatcacacccggctaatttttgtatttttagtagagatgagatttcaccatgttggccaggctggtcttcaactcctgacctcaggcgatctgcccacctcagtctcccaaagtgctgggattatagacatgagccactgcacctggcgggattctctgttttatactggtgctttgaggaagcagtatgttcttctcttgtccccagaagagaatcctagtgacaaagtctatcttgactaacagaaccaaggcaaggaaggtgggccactggaggggtctctgacatccattccctgatcctgaaggaccactgtggagttatacctacagccagcagtgtccctgcaccattctcatcccagttgagaataccttccccccacggccatattttgtcttctcgtggtgggcccatggggactctggcagcagaaatgctgctggaaaaaccccattctgcagaaggagttctccaaaggcctcttgaattgcatttgacccagncctagtcttttgcccaccatagccttggcacattcctgctgccaggaaatgggtgctttgataagccagttgtctgcatacaggcgtttcagtgagcaggccccattctctttacccatagatttggcaaagatgttcctatccagagtggaactatcttagctgccttcagaatggattctgtttgcaaaccttgagactaaagactaaactaccattcattaattccctcacttcctcaaccctttttatccccccatctcaacaggtgtgcatgcaggtaagccaggaagagcccaaaaatagctacaggtaaccctttgccttgggcatctgacgtccaccagcaagaatagtgcagcctggactaatgactgcctcatcctctcacactctggccactaatttagagcaaaagtaggaactcagcatagagaggttggagaaggttgacggaccttggcattatgcttgcaattccagaaataaccaccaggagtctccctagtaatgactgttttgatccaaaggatctgtgggctccagacagggcagactgattctgggatgtagtgaaggcttttgtacacctgtaggctattaagggttccctccacacccacgtaaggcagggctggcaacacaatggaaatgtcctacctgcccatcctagggacctgtcgtctgaggctccctaggaaaaagggaaggagttcagacccctcctggggcagcccaaagctcaggaccaagtatgcagttaccctggagctcctgcctggaaggagcactgtgccaggaggaatctgacagcccccaattggagctgtagctctgcatccaattagctccacggtagtggactgtctgctgcctctcttgatatctgtgaatagggctaacgagtcctgcctgcccctgcgcaaactaagagattcattgtgtcggttgtgggggaagctagaggctacgtggtctcccaagtttgtttctgtcccaaaattctctattttgtgctttttctataaaagtacatttctttatgaaaagcaccaagtctaaccaagctctagctctaactcagaggacagactgggacaggaacttagacgccctggagtggctaatttgttggtcagaagatgctgggggttgagaggccagactgggcaggagaggaccccaggaactctagggaaactccaggccccatcaataagccatctgggggtatctgcttcaggagatggggggtgggctccccactgcagaggcagggtggcccctgagagatggcatccttccacggaaggccccacaccgcacgggccgcctctgctctcctgtgtcacctgtctctgctgtttcatcttcctcttctcctctggctacagggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgaaaaaaaaaa

SEQ ID NO: 52626 - DNA, 7140 bp, Homo sapiens
  misc_feature (3216)..(3216): n is a, c, g, or t
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacgtaaggccagcagcagcggggcctgggcccctgggccctgcccagaaactgcaggggcgggggtggcggggtgaagccatactcgctgtttcctctcgtccacccagggagcactctggcgaatgcatttcctgttctgttctttccttttgcaagaagcgatggatgtggggagaaaaaggaatgaggcccgtttgctccttgtgtccgggagggtgaggagaatccagaggaagcgggcctgggtcggccgcaggcacagcctggaactctgccccagtgggccctgtctgggaccgtgggcttctcctcccacacattaccttccagagctcagggcctccccagcacctcctcatttccctttagagccagctctctatcctgacccaggagtcttggcatgaattgcctctggagaggcttgtgaatatggtctaagtttgtttcctttgtttatttcatcaaacactttttgattgcatactgggcaccagctcccaggaggcaaaggccctagctgcctagctcttgatgactagtggggcagacagatgggctctgcaacagtgtgggagtaaattgaaggtgggttgagcttctgaggacagttggaagccatgtcgaggctctaacatgaaatattggggtctgggtgtggggaccaccttgaatttttgttttatcacacagttggtaatgcagaggctcccctctgccatatcctgaagacagacatcatagggttagatcctcaaatgcacgagacggctttttccaaaactcagttaatgtcactttattaaccagcgaaatagataataaaaaagaaatgaggtgaacacattggacaaaaccattacttgccagtgacatgattctctacctggagaactcaagagaataacttgaaaagctattagaatgaataataagcatgtacataacagtgttgcttggaaatcagtgtgtaaaaatcaatcactttcctatagatgagtcgtaattatggaaccatttttttcaatccacaataatgaaaagtgcttataaaaatagctaagagtaaacttcagagaagctgcctcagtctgctcaggtgggcggcagagattgctggcccggggactttagatggcctcctcagagtaggaaggtcatttgcagcctggggccctgctcaggcctgggattctcttttttattgttttattttatttatttgtatgtgtgtgtgatggagtttcactcttgtcacccaggatggagtgcagtgacgcagtctcagctcactgcaaccaacaccttccaggctcaaacaattctcctgcctcagcctcccgagcagctggcattacagatgcctgccatcacacccggctaatttttgtatttttagtagagatgagatttcaccatgttggccaggctggtcttcaactcctgacctcaggcgatctgcccacctcagtctcccaaagtgctgggattatagacatgagccactgcacctggcgggattctctgttttatactggtgctttgaggaagcagtatgttcttctcttgtccccagaagagaatcctagtgacaaagtctatcttgactaacagaaccaaggcaaggaaggtgggccactggaggggtctctgacatccattccctgatcctgaaggaccactgtggagttatacctacagccagcagtgtccctgcaccattctcatcccagttgagaataccttccccccacggccatattttgtcttctcgtggtgggcccatggggactctggcagcagaaatgctgctggaaaaaccccattctgcagaaggagttctccaaaggcctcttgaattgcatttgacccagncctagtcttttgcccaccatagccttggcacattcctgctgccaggaaatgggtgctttgataagccagttgtctgcatacaggcgtttcagtgagcaggccccattctctttacccatagatttggcaaagatgttcctatccagagtggaactatcttagctgccttcagaatggattctgtttgcaaaccttgagactaaagactaaactaccattcattaattccctcacttcctcaaccctttttatccccccatctcaacaggtgtgcatgcaggtaagccaggaagagcccaaaaatagctacaggtaaccctttgccttgggcatctgacgtccaccagcaagaatagtgcagcctggactaatgactgcctcatcctctcacactctggccactaatttagagcaaaagtaggaactcagcatagagaggttggagaaggttgacggaccttggcattatgcttgcaattccagaaataaccaccaggagtctccctagtaatgactgttttgatccaaaggatctgtgggctccagacagggcagactgattctgggatgtagtgaaggcttttgtacacctgtaggctattaagggttccctccacacccacgtaaggcagggctggcaacacaatggaaatgtcctacctgcccatcctagggacctgtcgtctgaggctccctaggaaaaagggaaggagttcagacccctcctggggcagcccaaagctcaggaccaagtatgcagttaccctggagctcctgcctggaaggagcactgtgccaggaggaatctgacagcccccaattggagctgtagctctgcatccaattagctccacggtagtggactgtctgctgcctctcttgatatctgtgaatagggctaacgagtcctgcctgcccctgcgcaaactaagagattcattgtgtcggttgtgggggaagctagaggctacgtggtctcccaagtttgtttctgtcccaaaattctctattttgtgctttttctataaaagtacatttctttatgaaaagcaccaagtctaaccaagctctagctctaactcagaggacagactgggacaggaacttagacgccctggagtggctaatttgttggtcagaagatgctgggggttgagaggccagactgggcaggagaggaccccaggaactctagggaaactccaggccccatcaataagccatctgggggtatctgcttcaggagatggggggtgggctccccactgcagaggcagggtggcccctgagagatggcatccttccacggaaggccccacaccgcacgggccgcctctgctctcctgtgtcacctgtctctgctgtttcatcttcctcttctcctctggctacagggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgaaaaaaaaaa

SEQ ID NO: 52627 - DNA, 3650 bp, Homo sapiens
agggagagggaaggtcaggcttgcctcctgttcacaaggacaacctctgtctcccttgtggcggcttctatgaaggtggggactccaggctttctctcgtctgctttttggatgccttcaagagaggccagttagaggatatcaattgtggcaattccccagagccctcatcagatggcattagcccgtcatgtgctgcagtggcacccagtttggaggaaattcggaaccagaagagtgtgacagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgaaaaaaaaaa

SEQ ID NO: 52628 - DNA, 3870 bp, Homo sapiens
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgaaaaaaaaaa

SEQ ID NO: 52629 - DNA, 1839 bp, Homo sapiens
tagtttagaagttcaatagcacctagtttagaagttcaatagcacattcctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgaaaaaaaaaa

SEQ ID NO: 52630 - DNA, 3924 bp, Homo sapiens
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgaaaaaaaaaa

SEQ ID NO: 52631 - DNA, 3853 bp, Homo sapiens
gagccgttcccacgtgagaggctccgcggccgaattcaattcctcgcgtgcagcaggcgcggaccgcccggcgtccggccggactgagagccctggtccggcgcgcgccgccggccgggcgggaggcgggggcgggctcggctgcgccccgatgcggcggcgacctccgggtctgtgagcccggcgcgcgccgtcggagcccctcgcgcagccgctggtagcgtccccccgggcacccggcatgcgggcggccgactcgggctcgtgggagcgcgtccgccagctcgcggcgcagggcgagccggcgccttcctgcggggcgggggccgggcccgcgcggcccccgggacccgcagcctgcgagcagtgcgtggacgcggcggggcccggcgatcggccccgcgccggggttccccgggtccgagcggatggcgactgcagccagcccgtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgaaaaaaaaaa

SEQ ID NO: 52632 - DNA, 3659 bp, Homo sapiens
gcatcagcagctgtctgccagtgttgacggagggctcatgggtgccaggccgcttgctggggctttttatctgtcctcaggcattggcacagcagccctgggagatgaatactattgtgatcttcattctccacacaaggacagggaagtgacgtgccagggtcaaacaactacccaaggacagagccaggatttgaaccaggccatccagttccagaaccactgctcttcactgtcattgtggccattttacagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgaaaaaaaaaa

SEQ ID NO: 52633 - DNA, 298 bp, Homo sapiens
agaaaatcaagatcaagagaggttgcggaccacagagcttattggtatcaatgacaatacgggaacccagttcatctactcttccacggtgtctgacaatgcatgtgcattcccagaaaggctgtgctagaagagtctatgactcaggaagcattagcatcctcaagtgcctataaaataacaaaaatggctcattaaagtctaaaccaaatattgctatatagtatagcttattttaaaggtttatttaaaggtttaatagctgcccttcgttctaaagtgcaaggaaatcaaagag

SEQ ID NO: 52634 - DNA, 440 bp, Homo sapiens
gagtcagagtcttgctctgtcgcccaggttggggtgcaatggcgcggtctcagctcactgcaacctccacctcccaggttcaagcaattctcctgcctcagcctacccagtagctgggattacaagcgcccgccaccacacctatctaatttttttctttgtttgtttgtttgttttttagtggagacagtgaaaccatgtttaccaggctggtctcgaactcctgacctcaaatgatctgcttgcctcagcctcccaaagtgctaggattataggcgtgagccaccacgccccggcctgtttttctgttttttaaccagcggctctcaaactttagagtacgttagaatcttctgaaagtgtactaaaactgattgctggggcccactcccagagtttctcattcagtaggtctggggtgggaccagaatgtttatttc

SEQ ID NO: 52635 - DNA, 3141 bp, Homo sapiens
gcatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaaca

SEQ ID NO: 52636 - DNA, 3087 bp, Homo sapiens
gcatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggacagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaaca

SEQ ID NO: 52637 - DNA, 2947 bp, Homo sapiens
gcatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaaca

SEQ ID NO: 52638 - DNA, 3170 bp, Homo sapiens
gcatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggagtaagtactcaacgatgtaacacgaaaggggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaaca

SEQ ID NO: 52639 - DNA, 646 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaagtcgacgcggccgcgaatttagtagtagtaggcggccgc

SEQ ID NO: 52640 - DNA, 652 bp, Homo sapiens
  misc_feature (600)..(600): n is a, c, g, or t
  misc_feature (607)..(607): n is a, c, g, or t
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgtgtggtggggtttcataacaccatctatctanagcaagngctttaaaggataaatgcgctgaatctttttctgggggggggaag

SEQ ID NO: 52641 - DNA, 737 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgtaagactttgttaattctttgctgcttctatttgaaacctagagccacacttagggaagggtaaatttccaaatatccatgaagttctaagtgattgctttggacccattctcctgcttcctgcaaggagagtatagaagttctgaactttgtgatggtgctaccctgaaacatcagatgttatatgtgacagagttggatggggttttgacaattctagtaccccactagacccaagtttcactttttcacataccatcaccttcagcatcatctgtacatattcttgttttccttcatctgctctgcatcgcacacacagaggtatatgattctaaagtgatccgatctgaccatgtggccctggcactcccaaacatcatacataggtagcactctagttaattaggctatagggtttggcttgatgttatgg

SEQ ID NO: 52642 - DNA, 844 bp, Homo sapiens
cggatgttcttgcccggtgagcaggaccagcgagcatggcagtacagtgtagcagtggactgacattgctgctgagatttgcagcccgggttacgttttgcatgccatgaagctatggagcctcaagtagacaagttttcaagcctaccaaaatcttgcccgcccgttttcagggccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggtaagtagtcattaaattctcgttgatgttgttggtgtgaccaatagttattaatgggataattttatctcaaattcctggctattagaaaggtaacacttaaatctgtaagtcctgtctcctaggctggagccatatatttttggtgtcttaaaagaaattaagtgaaaactttacttacagaatgagcagatgtaagtgctactattactatgttttgtgggtttttctggcctacatttattataattaaaacgttaaatttcgtaaaactaaaatgtaatttttccttatccattttagataccttgaaacggagattacctagatagaaacttatgggatttatttattcgtttgtgatagacttctatgcagccttggctgtgttgaaggaaagcaagaatttctttgaataccaaaaaatagaccacagaattcatgttctagtgtttgtatccttttacttatacaggagagggctttcattaataaaaagggttttgacattttaaacag

SEQ ID NO: 52643 - DNA, 818 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggtttgtttatggtttggggatggaagtgaagtcggggagattggagatttagtttacttattctgttgcttttggttttaggccgttacgttttgcaagccatgaagcatatggagcctcaagtaaaacaagtttttcaaagcctaccaaaatctgtaagactttgttaattctttgctgcttctatttgaaacctagagccacacttagggaagggtaaatttccaaatatccatgaagttctaagtgattgctttggacccattctcctgcttcctgcaaggagagtatagaagttctgaactttgtgatggtgctaccctgaaacatcagatgttatatgtgacagagttggatggggttttgacaattctagtaccccactagacccaagtttcactttttcacataccatcaccttcagcatcatctgtacatattcttgttttccttcatctgctctgcatcgcacacacagaggtatatgattctaaagtgatccgatctgaccatgtggccctggcactcccaaacatcatacataggtagcactctagttaattaggctatagggtttggcttgatgttatgg

SEQ ID NO: 52644 - DNA, 1401 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 52645 - DNA, 1373 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 52646 - DNA, 1398 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 52647 - DNA, 1284 bp, Homo sapiens
ctttgtcgtgactggaaaacctgccggactatggaagcaagggagcccagccggagcatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 52648 - DNA, 1302 bp, Homo sapiens
caaactgccacggggtgacaacctgagcagtgcatgaatcgattcctaggatggatgtgctgaggtctattactggagtctatcaatcgaggagatcctagagacgactctcagattatcaaaattatcgccccaccctgccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 52649 - DNA, 1302 bp, Homo sapiens
tgttgtaatgggtactgcaagttcaacacatttttgagagtgccttacttttctaagtagtttcccaatttaggatacgcattgggtgtgttgaggtttctaaacagcttttcatactgttgtgttaatttactacagtttcacagtgtctttaattggcctttatgtacagttttttgatgtgatgcagaagtaggatgaagtaaataccatttctttttttaattagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 52650 - DNA, 1247 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatgccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 52651 - DNA, 970 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggtaagtagtcattaaattctcgttgatgttgttggtgtgaccaatagttattaatgggataattttatctcaaattcctggctattagaaaggtaacacttaaatctgtaagtcctgtctcctaggctggagccatatatttttggtgtcttaaaagaaattaagtgaaaactttacttacagaatgagcagatgtaagtgctactattactatgttttgtgggtttttctggcctacatttattataattaaaacgttaaatttcgtaaaactaaaatgtaatttttccttatccattttagataccttgaaacggagattacctagatagaaacttatgggatttatttattcgtttgtgatagacttctatgcagccttggctgtgttgaaggaaagcaagaatttctttgaataccaaaaaatagaccacagaattcatgttctagtgtttgtatccttttacttatacaggagagggctttcattaataaaaagggttttgacattttaaacag

SEQ ID NO: 52652 - DNA, 631 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaatcctgccaggaccgagctcgatcc

SEQ ID NO: 52653 - DNA, 1453 bp, Homo sapiens
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 52654 - DNA, 1341 bp, Homo sapiens
cgtgcgtgacggggaagaacctggcgtgctccgggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 52655 - DNA, 235 bp, Homo sapiens
gtccccacccaaatctcatgtcaaactgtaatccccatgtgtcaggggaggggcctgatgggaggtgattgaatcatgggggccgacttcccccttgctcttctcatgatagagttctcatgagatctgggtgaaagtgtgtaacacttcccccttcactctctctcctgttctgacatatgaagacatacttgcttccccttcacctttcaccatgattgtaactttcctgagg

SEQ ID NO: 52656 - DNA, 396 bp, Homo sapiens
cagatttctgctatgattttgactcatatgttatttggtgatgtattttaattctttaattttttgagatagagtcttgctctgtcattgaggctggagtgcagtggtgtgatcacggctcactgtagcctcaacctcctaggctcaagcgatcctcccacctcagccactggagtagctgggactacaggcacatgccaccacttttggctaatttttgttgttgttgttgtttttgtattttttgtagagacagggttttgccatgttgcccaggctggtctcaaattcctgggctctactgatcctcctgctttggcctcccaaagtgctagaattacaagtgtgagccaccatgccaagcctagtgatatatttctaaataactgaaaaaaa

SEQ ID NO: 52657 - DNA, 518 bp, Homo sapiens
agaacacacaataattttaaagcctctccttttaacattctcatataagcatgagcaatgctgaatccccctgtacaaggaagcaactatattcctgctcagatattgcaccaattatagggagcttatggcaacccaaattacacagggaccagtcacccaagtgctctgtggaagcttaatggggcttcttttggaaaggaggacaatccaatacagcactaatggcaaagagaaaaatgctaaagcaagccaagagaaatatagcagccatctgatgacagctgagggaacaaaacaaaaagctggccccaaaacgcagactgaccaacaaaatgggaagaactctactatgacttctacttcagtgtggataaatgtgaactcataaagaaattacagtaaaaagctatttctgaaaacatcagccactacaggaagtactcaagtcacttagcaaacattgagcacctctaagttgtacaaggcttccactcaataaataataaaaaccaaaa

SEQ ID NO: 52658 - DNA, 850 bp, Homo sapiens
gaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgatggccctttcagtcatgacggttgccagcccatggccatagccatgtatagtagctctcaaccatgtcacctatcaggatactgataattggtttaatgtctatctgtgaacaggtggatgactgttcgtcagtatgtctggtaaggaacctactagatcaccac

SEQ ID NO: 52659 - DNA, 712 bp, Homo sapiens
agcgaccgcccttttggcagggatcattgaccctgatctattcgtcgggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgatggccctttcagtcatgacggttgccagcccatggccatagccatgtatagtagctctcaaccatgtcacctatcaggatactgataattggtttaatgtctatctgtgaacaggtggatgactgttcgtcagtatgtctggtaaggaacctactagatcaccac

SEQ ID NO: 52660 - DNA, 821 bp, Homo sapiens
gaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcct

SEQ ID NO: 52661 - DNA, 505 bp, Homo sapiens
gaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggctcaatcactagtgaattccggccgcctgcaggtcgacaatatggagagctcccaacagcgttgatgca

SEQ ID NO: 52662 - DNA, 1332 bp, Homo sapiens
aatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttagccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccctccctccctcccttcttcctctctctctctctcactcacgcacacgcacacacacacacacacacacacacacacactccattctctgtctccatgactctggagtaaactaacgtctcgagttgccatttggaagccccattgtcctcattttgtttgtgtttgtgttgtgtttgagacgggggtctcgctctgtcccccaggcgtggagtgcagtggtgcgatctcagcccacgtgcagtctccgcctcctaggttcaagcgattctccgtgtctcaccctcctgagtagctgtgatcataggtgcccgacaccacacccgactaatttttgtgttttttagtagagacagggtttcactatgttggccaggctggtctcaaactcctgacctcaggtgatccgcccaccttggcctcccaaagtgctgggattacaggagtgagccaccatgcccagcctccgttgtcctcatttagactttcatgggttataggcacttttgacttcctggggtccttcttcagttaaaaaaaaaaattagaaaattaggccgggcgtggtggcacatgcctgtaatcccagcactttatgaggccgaggtgggaggatcacctgaggtcgggagttcaagaccagcctgaccaatgtggagaaaccccgtccctactaaaaatagaaaattatttgggtgtggtggtgcatgcctgtaatcccagctactcaggaggctgaggcaggagaatcgcttgaacccgggaggtggaggttgcggtcagccgagatcatgccactgcac

SEQ ID NO: 52663 - DNA, 663 bp, Homo sapiens
aatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttagccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccctccctccctcccttcttcctctctctctctctcactcacgcacacgcacacacacacacacacactccattcagtgtctctatgagtctggagtacactacagcgtctcgacgtcgccatggggcccgcgg

SEQ ID NO: 52664 - DNA, 403 bp, Homo sapiens
gttgttttcacacttcactgaggtttaggattgcaaggcatcttctaagttttgtctcattgcccttgattccttgctgtcttataatacaactacaagcctcaaaagaaccaaaacgaagctgttctcttccatcctcactgccttagaatgtgttgtgttcttagcagaaatgagaagaggagccctcttcttctagagtttaggtgtagtcttggagaccctccttactctcctccactgattctgcccttggccctcggtgcctaagtttctcctctatgcccttctctgcatgcaaaacaagcagacatctctgggtcaccagcatcaccaatttctcaaacagacccacacttagcttaggaccaccccagtgctcctcagcctctgcagccaggca

SEQ ID NO: 52665 - DNA, 439 bp, Homo sapiens
agaaggtggaatcatcaagttagcctgttttctttactagattataaactctttcaaactagggactatgtcttcatctctgaaccccttacaacctttagcatgatgtcttgccagatgttcggtgtctgtagaatgtcaaacatccatgcttgcatacattgcaagggaagttgggctaaacacttctaccatcctgccttcttctaagagttaattattattactatttttttttcttagacagagtcttgctctgtcacccaggctgagtgcagtggtgtgatctcggctcactgcaacctttgcctcccaggttcaagtgattcttgtgcctcagcctcctgaatagctgggattacaggcgcccgcctccgtgcccggctaattttttgtatttttagtagagacgaagttttgccatgttggcctggctggt

SEQ ID NO: 52666 - DNA, 328 bp, Homo sapiens
acaaaatcaatattaatataaaatcaactgctatatttttaaagagtagtgtttggattacataagcaatcataaaactcccgttggctttagcaagaggtttagtcctgtaaactccaaaggttttctgtgtgtgctgagcagacaagcatcctaacagaataagccagaactttcctagccatcctagcatgtttgtgccttgtaagatattcccagttacatcctttaatttgccaaagggcagaaaaagaatttggtaagttaactttcccacatgcacaaatttaactgctgttttggtattccacacaggggccagattgga

SEQ ID NO: 52667 - DNA, 348 bp, Homo sapiens
gtgtgtgtgtgtgtgtgtgtgtgtgtgtgtgtgagagagagagagagagagtatgagtgtgtgcctggcaacggtgaaatcagtaagaggttaacaagttcttttgtttccccagttgaatttaggcatagtaagtaaacaaaccgacattttaacatgtgcttcagaaaacgggaaaggtaaaagtcacttccaaaaggcccaagaaatgtgcacatttatagcaaagcaagggtgagtggaatttgagtacataatatagagaagcaaacctatggtagtaccaaaaattccgccagtgatcattcctgggcttcaggacctgccatgatgccctggaaatgaggc

SEQ ID NO: 52668 - DNA, 697 bp, Homo sapiens
ccacatgcttttcatcacccgctctcacatcccatctggggcctctgcttccatcctaccatttcgcaagcctggccaactcaagctccgtgtgctgcacctagagcagcccatctctgtgtcagggaggtgagctgctcagttgccagagtatcaacctgagcccaggacactgccagactgctgagtcaaagagggtttagcagcccattttcatagacagacaggtgagaggaggatgctggacatggtcccagagacatggggactcaagaaacatgaagatctgttcacagctaagggcacatttccatgccgagaaatcaggcgtgagcgcaagagtcctatcgtctaccagaaaaagaaatctttgggagaactgcaatccaagcaaatgtggtgggtgtgaagctttcaagaagttgggtcaagaacaaggactgaaagaggagcatcaatttgtaagttcaggaatgtctgctccatctttgcagagacaagcaaatatcagggaccacccaagtccattcattgtgaactaagtgaatcatgacacaaccacacaatggaacaccgtgcaggattatgatatacagactgctgaagatctagagttattgatatggaaagatgcccatgatgtattgttagcaaaaaaaatcagcctacaaaacaacatgcatagcataatcctatt

SEQ ID NO: 52669 - DNA, 793 bp, Homo sapiens
ccacatgcttttcatcacccgctctcacatcccatctggggcctctgcttccatcctaccatttcgcaagcctggccaactcaagctccgtgtgctgcacctagagcagcccatctctgtgtcagggaggtgagctgctcagttgccagagtatcaacctgagcccaggacactgccagactgctgagtcaaagagggtttagcagcccattttcatagacagacaggtgagaggaggatgctggacatggtcccagagacatggggactcaagaaacatgaagatctgttcacagctaagggcacatttccatgccgagaaatcaggcgtgagcgcaagagtcctatcgtctaccagaaaaagaaatctttgggagcattcaaggaggaatggcttcatgatggcaatgagcggcatcgcctgaaagacagccttcgagagtctcccagagccgctgaggagcaaggcagagaactgcaatccaagcaaatgtggtgggtgtgaagctttcaagaagttgggtcaagaacaaggactgaaagaggagcatcaatttgtaagttcaggaatgtctgctccatctttgcagagacaagcaaatatcagggaccacccaagtccattcattgtgaactaagtgaatcatgacacaaccacacaatggaacaccgtgcaggattatgatatacagactgctgaagatctagagttattgatatggaaagatgcccatgatgtattgttagcaaaaaaaatcagcctacaaaacaacatgcatagcataatcctatt

SEQ ID NO: 52670 - DNA, 850 bp, Homo sapiens
ccacatgcttttcatcacccgctctcacatcccatctggggcctctgcttccatcctaccatttcgcaagcctggccaactcaagctccgtgtgctgcacctagagcagcccatctctgtgtcagggaggtgagctgctcagttgccagagtatcaacctgagcccaggacactgccagactgctgagtcaaagagggtttagcagcccattttcatagacagacaggtgagaggaggatgctggacatggtcccagagacatggggactcaagaaacatgaagatctgttcacagctaagggcacatttccatgccgagaaatcaggcgtgagcgcaagagtcctatcgtctaccagaaaaagaaatctttgggagcattcaaggaggaatggcttcatgatggcaatgagcggcatcgcctgaaagacagccttcgagagtctcccagagccgctgaggagcaaggcagctcccccacctacattccaccatattgaagggcttacctgtctggtgccagcaaaggagaactgcaatccaagcaaatgtggtgggtgtgaagctttcaagaagttgggtcaagaacaaggactgaaagaggagcatcaatttgtaagttcaggaatgtctgctccatctttgcagagacaagcaaatatcagggaccacccaagtccattcattgtgaactaagtgaatcatgacacaaccacacaatggaacaccgtgcaggattatgatatacagactgctgaagatctagagttattgatatggaaagatgcccatgatgtattgttagcaaaaaaaatcagcctacaaaacaacatgcatagcataatcctatt

SEQ ID NO: 52671 - DNA, 564 bp, Homo sapiens
atgaaaaacagcatcttgtcatttctagatgtttctactttggttgactctttaatttttctgcagttaaaagccttaaaacagcaaggaagcaggggacaggaggggagcccagatctctcccaaagaaaaggagaaagactgaatccttgaggcctgccgtacaaaggagtggtgggttggaggagggtaggcagagactagggtggtctgggactttaagtacaaggccccgtggatttcattggggggcaagccatgtgcaacagggaagctcaggaaccggggggtttcgcacagaggtctggtgctgtgaggtacagggaaagaattagtggatctggaccagtggaacattggtttagtgtaatctctgatttgtgttgagtgaatttgagtatagtccaaccaccacccccctaccccaactaaaccatgtgcccctcaggagctgggactcttctattttctattccttatagcaggctcagtgcctgacacactacgttgaattttattttaaacatttcatttacattaaatggtatatttgcaagttcattc

SEQ ID NO: 52672 - DNA, 319 bp, Homo sapiens
ctcaggtggcagatgtttgagaaaaggaattatgccaggaaggtgggaccgggttatggtcgggtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttaaatgtgtagtatttgaggaaaaaaatcaataaacagttgatctcgtgcaaaaaaaaaaaaaa

SEQ ID NO: 52673 - DNA, 1030 bp, Homo sapiens
ctcaggtggcagatgtttgagaaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacatctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttaaatgtgtagtatttgaggaaaaaaatcaataaacagttgatctcgtgcaaaaaaaaaaaaaa

SEQ ID NO: 52674 - DNA, 1307 bp, Homo sapiens
  misc_feature (1307)..(1307): n is a, c, g, or t
ctcaggtggcagatgtttgagaaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacatctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttaaatgtgtagtatttgaggaaaaaaatcaataaacagttgatctcgtgcaaaaaaaaaaaaaaaaaaaaaaagaaaaaaaaaaaaaaactgcgggggcttttgtgtgggggggggggaaaaaggggggtaggaaaagggggcgacaccggggcggccaaacacgaggtgtcccctagcggaccccagggtcgtcgtgcgtgccccaacgaaggggggaaacaacccagacgggaagacccccaatagtggagagggccgcatcacaaactttgcgaacaaacgcgcggggtatccccgggaataaagtgattctgccacaaagaagagacacgacaacgn

SEQ ID NO: 52675 - DNA, 345 bp, Homo sapiens
ggagaagacaaattgattttagatttaagatcaggggaacaatagcaaaataaaatgtttttagttgttttcaaattgattccattaaacttttaagtgttatattcaaggcactatgctagtggctttggataaacagatatttaataaaacatgatacttgtacattctacaaaattgtatactaaaaataatggattattaaaaaatagggttgggtgcagaccactcaaaatctgtgcaacattgacccatggtacccagaacacaagggcttggacagcccaggcaggcagctcagcataggtggaggttgccatagattatattaaattaaaaatgcac

SEQ ID NO: 52676 - DNA, 345 bp, Homo sapiens
ctgtgagggcacaagtgtaggtatcttttcaagttctctaggtgattctagaatgcagcagggttgagatgctctgccttaggggtagagaggtgggaacactgacaggttctgcaaaacatctctgaacagctgctggtgtctttttctgtacttcaagtttcacggcacatctgatagctgtgccgaaagggaagagagaattacgtgggctaggctggtttgaaggtttgcgtaagttttggcttgagcgacttaacacgtttatttcaaagtaatttgtgtttgtagcctcactaaagtaatttggggccagaaaggttcaaaatacgttttcctacttag

SEQ ID NO: 52677 - DNA, 450 bp, Homo sapiens
agaatgagtaaggcagagtagaattttattaagtgacagaaagaaagctctcagcatcaagaaaagactcaaaaataggaagccatctgtaaggctgagtccagggttttttatgggcttagaatggggaagtgcatgctgtttggtctatgggtgggcttgggaaaaagcaccatttgactggttaaaaggcatcattcagaaggaaccagtcgagagagaaagtggataagatggggatggaagttctcactctggtcatggattctatctgaaactggcagcttgattttcaggctttaaactatccttggcttgaaggcggagtttcaccagggatctgtccttgtctacctaggaatttgtctgtctcctgtcactgtgataaagagacgtggcacatatttatgctttaaagactgactggagtcttagaagttaatacgaaaa

SEQ ID NO: 52678 - DNA, 186 bp, Homo sapiens
gatagagcaggtcggcttgcagaagggatgcagtggacaggcagctgactcctcagaagggccccagaattgggtgtcccatattgtatgatgtgaggatgaggtacaaggatgaaaggaaggattgattgacattctctaaattaaagggttgggacccaggtctcctgtcccatcctgaacagc

SEQ ID NO: 52679 - DNA, 206 bp, Homo sapiens
agctaatcttattcccattttacagatggggagactgagacccatcatagttaggtaacttctccagagttactctactggtaagtggaagagctaggattgaaaaccatgtttccgtgagcccttcactcatattcatcctgctatactgcaaggggacagtgagagaaaaacccgaaagaagcagaagaaggagaacattaaat

SEQ ID NO: 52680 - DNA, 175 bp, Homo sapiens
tggggcagctaggaaggggcagattaatggaaatagcaatactgggcctgggcagcctccctttgaagaccaccctctccaggagactcctgcattggcttctctcagtggcacctcggggtttccgccagagttgctgggttgcctaattacctccaatattttttcctcttag

SEQ ID NO: 52681 - DNA, 351 bp, Homo sapiens
ggtgagacagagtgggtatgaaaaaacatataacctgaaaaatctacttatatatgctaaactaataaacctgagggatatgcagggggaaaaaatcaaattttaaggaaatcctaacacagaaaataaattcacaatgaaataaaaacataaaattgtgcaagcaaaataaaaatactacacttaaacataaaatatacttgttaaaatatggtaactctttaccccacaattaaaaaagctttaatcaccagtctgatttctatttattttgcactgagattctttcctatgagaaatacatcacagttgatttactttaaaagcaagcccatttagtgtttgaaatta

SEQ ID NO: 52682 - DNA, 712 bp, Homo sapiens
gccagggcactgagtctgtcaccaactgggcactggagagatgaaaccaaaggtgggcaggggttggcgacagcactggggactatccctgtgggtcctaggtctgtgaagcccctccccaatgcctgtgtcgcgtacagttttatgtaccaataggcgacatttggccagaggagagcccccctcaaacccagcctgacccagtctgtgtcttcccagaggggacctagtcggtccccatccccctacttcagggcatgtctctccgtagggggagggtatatggggacatatttctctcctagggtccttgaagcatgtttcacattccggggtggggggaagttctctgggcatccctcacctctggggtctctctaggccctatctctccccttgggagtctccgggggacatgtgttcccgctgaggaccacgggagcatgtctcccccaattacccaggctctctggggagcctgttttcctcccagggttcctgggagtacttaaggcaagtcagtttcgggccatctctcttcccagggaagggggctatctctgaaacacgtctgggaagggatgtttctggccctacccccatctctcctatgggggtttctctgccctgcagcactttaggatgaggctgggcatctctgagttgtcttttctcctaggagccctgggatacctctctctcccgagggtag

SEQ ID NO: 52683 - DNA, 617 bp, Homo sapiens
gaaactatcctaagcatgttatggacattgtatcatttagtccttacagaattgtattgagtacttcagactttaaaaccaaatcactttgactccaatttagccattgtactaaccatactgtgatcaggtaacttctgaggtatagaaattcatgtgttaaacatctgagggattcttaaattttgatggatgctggagatatagtggtgagcaaagggagacagaacctcagatctcatgccacttacaacattttgaagtacatagacattaatacaataaatacatatttacagactgaggtcagtactatgaagatgagttctgagatcctttaataaaagcaagtttctggtcccaggcacagtggctcatgcctgtaattctagcaattttggaggctaaggtgggaggatcgcctgaggccaggagtttgagaccagcctgggcaatatagtgagaccctgctgctacacaaatttaaaaaaaaacccattagctgggaatgatgatgcacacctctagtcctagctactcaggaggctgaggcaggaggatcgtttgggcccaggagtttaaggctacaagtgagctatgattgggccactgtactc

SEQ ID NO: 52684 - DNA, 652 bp, Homo sapiens
ttactatataagtatatatgaagttttattataaggaatattaatatggtaccgtgaattgttaattaaggactaagaatctaaactttctggaatatgattatgtccaaaccattaagatgaaagtgcttcatatgcattctaaacaataccttcggtcagatgtgggattttctttttcctgtaaatgttgatgcaaattcctttaatgaattttgtatgatgcagcctttgagttaaacagcaagtagtaaagggtaaaggaaagaaagacgataaaaacttgttcaccttttcaccgaaattcgtagtatagaatacagcattgcttcctgggatcacaggcagcttgaccccgagaggtaggtccagtagctgagccggtccaacccctgcaaagtgggttttgtgcacgccctgtcagacacaattggagagttttgtctttccttttaggcagtattagtttagtttagaccaatctacttccattgcaaccaaagactccgaagaattatacaatcagggttcggggcatcctgaagtcctcccgttttccctggtcaccagctctcctggcgtcccgcgcctgccagttgcggccggtacagtccgagccaccgccaccgcccccgggcgccgcaagagggca

SEQ ID NO: 52685 - DNA, 1770 bp, Homo sapiens
ggccttgaactcggggctcaagccgtcctcccacctcagcctcccaaagagctggtattacaggtgtgagccaccagccatggttagttttcatcaactgctttctcaccttcttttcatcctctaattcatacctgcaatccttattagaaatcctgtcaacttaatagtaccagaaagtcaggcaaaagactgataaaaaaaaagcctcggtggtcaagaacttaaaattacactactggtgtgcaacgtgctcttatctgtgttactggaggacaccctcaagatacctcactccagttgactccttggctctaaatctttgagttaaaaaataaggaggttctttatggaataaacaggtattaagctatttaaaggagagggctgcgaaatgcttgattatgggcttttcaagttcagaggccaagcgtttgtcattttcttccagtaactaggactgtgtcttgcccctaatagttactcagactatatttgcttaattgaattaaacacagttgcctatgccctttgaaattctggactttcaacagagggcctctagcccaatatttgcttaccaaactggacatcattgatgatctggattcaggcagggtctggaaaaagagagactgggccaaattaaaataatccattcactgatgacacaaaactaaactacaattgtttggcaccctctcttctccttatcttgcaaaatcaaattaagcactagtggaaagaaacagttcagagaggaatatggggaaaggaaaaaaaaaaaccaaaatgtgatttccaacgagactagagatttgttctttatctacatggtcatgttactcatttgatagcatctatctcaggggtattatgttatctcttggccaggactcatgaaagttaagatttgcattgataggaaaagttttgcagaaatatggactcttgagagggtgggaggtatataaaaagcggcagagcaatttgcatttcttatacaccctgcttgagactgatgtcattagtgttggttaggccaaggctgggggaggctactcagaatagtgggtgaccaattacccagaacctttggaaaaggaaatgacttgattgaagaggccattctttaaatgtatcttactgctcaatttcaccattgcctattgtagaatgcgcgctgcccgctcagcatttgcctctaggcagaccaggactccttcccctccccaactaatcttccttctcctgtatcttattccctagggccacttgcacctttcaaaatggataaattaaattcccctgctccccttctaccaactttaacatcatatccttggtgtatgatgccctacttttcattgttttgcctaaataagagtatgcttgggaattttaggcttagggctgggaaaagatgggatatggaatcgtcagctatagattgccggacaagaaattttaggagcagtagacctttcaaccgccctcaataggatggaactgactgtccccacaacctatttccctttcagtggcttgctccagccaaggccccttatttaagagatctttgtgcgctctgaaaaccatgcatatgccagaactaggtgctctgtttcatgaaggcagtttgataactgaatggactttggaagtgcccagtgtttgactattaccctggtgcgatgatcacactgggcgtatcattgtcacatgatcccatgtttgttgatgaaaataaacagtggttttcaaaaacca

SEQ ID NO: 52686 - DNA, 2458 bp, Homo sapiens
ggccttgaactcggggctcaagccgtcctcccacctcagcctcccaaagagctggtattacaggtgtgagccaccagccatggttagttttcatcaactgctttctcaccttcttttcatcctctaattcatacctgcaatccttattagaaatcctgtcaacttaatagtaccagaaagtcaggcaaaagactgataaaaaaaaagcctcggtggtcaagaacttaaaattacactactggtgtgcaacgtgctcttatctgtgttactggaggacaccctcaagatacctcactccagttgactccttggctctaaatctttgagttaaaaaataaggaggttctttatggaataaacaggtattaagctatttaaaggagagggctgcgaaatgcttgattatgggcttttcaagttcagaggccaagcgtttgtcattttcttccagtaactaggactgtgtcttgcccctaatagttactcagactatatttgcttaattgaattaaacacagttgcctatgccctttgaaattctggactttcaacagagggcctctagcccaatatttgcttaccaaactggacatcattgatgatctggattcaggcagggtctggaaaaagagagactgggccaaattaaaataatccattcactgatgacacaaaactaaactacaattgtttggcaccctctcttctccttatcttgcaaaatcaaattaagcactagtggaaagaaacagttcagagaggaatatggggaaaggaaaaaaaaaaaccaaaatgtgatttccaacgagactagagatttgttctttatctacatggtcatgttactcatttgatagcatctatctcaggggtattatgttatctcttggccaggactcatgaaagttaagatttgcattgataggaaaagttttgcagaaatatggactcttgagagggtgggaggtatataaaaagcggcagagcaatttgcatttcttatacaccctgcttgagactgatgtcattagtgttggttaggccaaggctgggggaggctactcagaatagtgggtgaccaattacccagaacctttggaaaaggaaatgacttgattgaagaggccattctttaaatgtatcttactgctcaatttcaccattgcctattgtagaatgcgcgctgcccgctcagcatttgcctctaggcagaccaggactccttcccctccccaactaatcttccttctcctgtatcttattccctagggccacttgcacctttcaaaatggataaattaaattcccctgctccccttctaccaactttaacatcatatccttggtgtatgatgccctacttttcattgttttgcctaaataagagtatgcttgggaattttaggcttagggctgggaaaagatgggatatggaatcgtcagctatagattgccggacaagaaattttaggagcagtagacctttcaaccgccctcaataggatggaactgactgtccccacaacctatttccctttcagtggcttgctccagccaaggccccttatttaagagatctttgtgcgctctgaaaaccatgcatatgccagaactaggtgctctgtttcatgaaggcagtttgataactgaatggactttggaagtgcccagtgtttgactattaccctggtgcgatgatcacactgggcgtatcattgtcacatgatcccatgtttgttgatgaaaataaacagtggttttcaaaaaccattttcagtgccatggtttgtcataaaacaataaatagaaaagcgcttgatgtacctgccaacttttcacccctatctaagagatggcgaagctccggctgcactctgtctgcaaataaggaataaaactttttatttgtgctatattggactttgggttccaaagcatcacattgtttatggtaggtacatgtggagtcactgtatttataattataagagcaaactggtgccattggaaaaaatggtctttctaaatagtgtgtgaaatatgaaactagtgaagaataaaatcaatatggaaatgtaaacttctatgaaaacatttccttacccatttaagtttgtgcattctgaaatttacaatggccatcaaacccagtgactcaaagctattggaaagatatctgtccttttaaatcctacacttacagctaaacaacgtatgggttcttttccctttatctctggaaaagcccgactgagctggaatttgctccccaaaggaaagacatcaggcagaatcctcagagaaaggggcttagggaccccagtagaaataaaatcaggatagtagtgccaattcatttctggggctgctggagaagttaggcttctgggatcattcatccatgtatcaatattaataaaataaattcttctattgccaggactgtcaggaatagcta

SEQ ID NO: 52687 - DNA, 333 bp, Homo sapiens
attctgcccagctgcttatcaggtgttgaatacatggcactagaaatggcccaagagccaggatctgcagtaggcatggggaggggagtgtgcaattgcatctctgttacccttctgcccagtttctaatgggcagctcttccagggtagtcaagaggttgctctacgtgatagcagatacagcagagggagaggaggctgtggagtccatagccagggaaggtgaatgctctgggcttcctccacagaaagaaaggatagctccagtagcatagggacccttctacaaccctctgcatcctgtgcaaagtcttttctttgacccaaaaaggg

SEQ ID NO: 52688 - DNA, 241 bp, Homo sapiens
ttgcattcctcccctaaattggagatggtaaaggtggagcctgttgagaatcagtgcccaacatctccgtcttacagaggccaacacattttagctaattctaacaacagcaatccatgttctgcaagtcaggctagccagctggagccacttactcctgtaggctcagatattatgtcttttgtggttggaacagaacaagcagttgcctgctctctaccacagtcacctgagtacatct

SEQ ID NO: 52689 - DNA, 326 bp, Homo sapiens
tatttttatattttattttatattatttctatatattttatgtatttttggttgttaataaaaatggtttctagataaggctctacctgtcatttaagccaaggccagattaaaactcatgataatgtcttcaggacatcaacacagttatttaaaaagtgaaaaggtcagttagtttgctgatggtttcgggtaaaaactgtcagtgtattgattgattgattttttttctttcccactggattgactgaattttccagttatgtcattgagtatgcaccaccttgactttagtgaatagataacagttactaagggggattctc

SEQ ID NO: 52690 - DNA, 189 bp, Homo sapiens
gcgagctggagctggtgttcagtagctgatggcgtggggcttccctggctgggcccatgcaggtttgcttaggccggtacactcgcgtggggtccacactgcctgaggcaggcacccccgcgccccatccttgtaggtttgtaatatgagcgcctcctccaagcagcccggaagccggccaggccctga

SEQ ID NO: 52691 - DNA, 641 bp, Homo sapiens
taggtgatggcattgccattcattaaaatagaaaacaactgaggaagcgaatattggaatagggtataaagtgatgaacttggttttgaatgtaagttagagatgcttgtaagacatcacgtgtttgagcacagatctgccatttaggagaaggaactgggctatagattaagacttggaggttgcagtgagccaagatcgcgccactgcgctccagcctggcgacagagcgagactccgtctcaaaaataaataaataaataaaaatgctgaaactatctattttagttaccctacagggttgttttaagacgttcacaggaggtaaggtagaagtttgttgaattataaagtgctacacaaatgtaaacaatcaacggcttttcaaccacatacagccagttatttagacttcagagaattcttttttcttttttcttttttttaggccagtgtgtctcaaatttcagtgtgtatgtggagggcttgctataacagattgcttgacctccatcgctagagtttttgagtcagtaggtcccttgtaagtctgaagaattgcattttttacaaattctcaggtgatgctgatactacaggatacttacaatgtgaatccacagtggggcattttaagtttc

SEQ ID NO: 52692 - DNA, 155 bp, Homo sapiens
gtgagctaggcaaacaaatgcatggagatttacatgccaggcaacagtcttaatatacaaaaaagtattaggagtaatgtcacttattcagggacctggagatagtttgctgtggttattgtataggtttgtatgaaaggcactcactattggtc

SEQ ID NO: 52693 - DNA, 717 bp, Homo sapiens
ataagccagaactttcctagccatcctagcatgtttgtgccttgtaagatattcccagttacatcctttaatttgccaaagggcagaaaaagaatttggtaagttaactttcccacatgcacaaatttaactgctgttttggtattccacacaggggccagattggatggaagggcaagagggctgctgagggagatcactgcaagtgaaggcaaaatctagtctgatggctcagactaaaaaacttggcctgccaataagagggagcagtgcttccagtgaaaatgtgaggcagtgcctggctttccctgctatactccaccctcctccactccctggactgcctgccaagaaagagaagggtgagcaatagagaaggaagtgaatcactagcacttcacaagtgctgctgcagaggcctgccatagagagctggctgagacctaggtgctctcctgctgatctgagagggcagaaaaataaataaatagaaatgtcaaaaagaggacagcagcagtgtagggaagggaggcagagaggaacaaccccgggcaggaggagtgtgggtcaaatgtgagaaccaataccctccttccctagctaaagttgttcccccatcagcctcagtttccaccatctctgaggcattcacaggaggaataactggtgtgttaaaatccaccaaccacttatatacaggaaagaaaaaaaaaaaga

SEQ ID NO: 52694 - DNA, 163 bp, Homo sapiens
aggaggagtgtggcccccccccccccccccccccctccttccctagctaaagttgttcccccatcagcctcagtttccaccatctctgaggcattcacaggaggaataactggtgtgttaaaatccaccaaccacttatatacaggaaagaaaaaaaaaaaga

SEQ ID NO: 52695 - DNA, 385 bp, Homo sapiens
aaaaaaaaaaaaaaattctccctgcctcagcctcttgagtagctgggattacaggcgccagccaacacgcccagctaatttttctacttttagtagagatagggttttgccatgttggccaggctcgtcttgaactcctgacttcaggtaatccgcctgccttggcctcccaaagtgctgagattacaggcgtgagccacgtcacctggcccgtgtgtctgtcttgagtggacagattgcagtttgaggaatgttgatgatgtttgcacttgtgtaatcccctccacagtccagatgtggaacttaccactaccccaaaggctcctgtgtccctcccatgtggcgtccccgccagctgttgctctgctgtgacctcaggtcactt

SEQ ID NO: 52696 - DNA, 378 bp, Homo sapiens
cgatcctcctgcctccacctcccaaagtgctgggattacaggcatgagccaccgcgcccagcctattcttaaagggctttttaagtctcactatacgtgttagtcttttaaagctgtttgttttacaaatatgattaagtatactagatcatatttgtttttttgttaagctctttattatggagtatttcagacatacacttgagtagaaagtatagtataataaattcccatgcactcatacccaacttcaacaattattaacttaaaaaaataccatttatttgttgaagaaaccagattctatttggccaattgattctttatagtattctttaacttctttaacttgttcttttaatctttgtatttcctata

SEQ ID NO: 52697 - DNA, 421 bp, Homo sapiens
gacggcaggcgcggcacaacggcgcattgtggggccaagcgaggggcgaagggggctgggggtggccggcgcgatggggacgctccggttgcgccaagttgactctgccgtttgggtcacctgggctgagtcgcgggcgtggaggcagagggtagggggtgaggaggtgtttcttgtcttcttcttccaatctcagaagtaaacattggaaagtggggcccccagcagtgtacagcccgtttccaaaccaggcctgtaaggaggagctgaggtttcggctgagcccccagcctcccccgaccgcacagcctcgggcatgaacccgcgaagccagacgcttagttgcttatcaggccatcgctgtacatatttagaaagtacctatcactcagacactttgaaaagcgtggcgttccagcgc

SEQ ID NO: 52698 - DNA, 216 bp, Homo sapiens
ccaaagtgctgggattacaggcgtgagccaccacacctggcctcagcccagcctcttaatgcaactatgtaaatgggccaggatccagctggccagaaataagagtagcatcctggagaacacagaggcagtgaggacaggcacaggcagggcagaggtaacagcagaaaggctgcaaggccagaagatgcccgctgccaccacaccacccggcca

SEQ ID NO: 52699 - DNA, 596 bp, Homo sapiens
taaccaaattctgctactacaacatgaaactctcccaccaaggaaatgttcaacaagaccttatcacctttaactactaagagattttggcagccaaaatacatgagtcctaattcttcatccccgttcacttttttttttttttgagacggagtttcactcttttcccccaggctgaagtgcaacagtgtgatcttggctcactgcaacctctgcctccccagttcaagcgattctcctgcgattctcctgcctcagcctcccgagtagctgggattacaggcacaagccactacacccagctaatttttgtatttttagtagagaaggggttttaccatattgggacgggctggttttgaactcgtgacctcaagtgatccgccgtcctcagcctcccaaagtgctgggattacaggcacgagccactgcacctggcccccattcacttctttcttcattctattcaatggtagacctggcacaattacttgtggatgtgtagaagacataggtaataaactgggcacaccagttgtgttttagcaagaaaaaaagtcggcctcactcatactctccagtctcatacatcttta

SEQ ID NO: 52700 - DNA, 482 bp, Homo sapiens
aacaatgtgataatgacactccttcattgacaggtgggtctctctgttctctcctcctgagcctgggtagacctttgtaactgtcttgaccaacagaatgtgacagaatgataccaggtgacttctaagactacatcatacaaagcaacacagcttctgctgggctctccctctctggacacgtgtctttgaagccctgagctgccagattaaacagtccggcttgcctaaagtcaccacgctggagagaccatcagggatggagaggtgctacagaaaccctagctattctagtccccagccatttgagtcttcctagcccagactcataagtgaagaaaccttcaagatgattccaatacctcctatcacttgactgcaacctcgtgaaagcctaagccagacctgcacggtggagccattcctaaattctggtcccacagaaactgtgaaagataataaatgatcatcattgctttaca

SEQ ID NO: 52701 - DNA, 448 bp, Homo sapiens
gccaggaccatgcaatcggaacgtgggcttgataccaagtgacatctaacaggtccagtaaaagaggcctacacaataaaggcagcatgtgagaaaggctgactctggaacatcaggataaactgctatagttttccactattgagctgaatttcgtatcaccatcaaaagttacctacctacaagtccctagtagagaaaatttaacttctggctttaaaaaagggacagaaaagcaggcagatctgctagtaagcaaactacagctcccccgaggagacacacaggcagtgggtaagaggaacagacccatggctccactgaagacacagagcagcagacgaaaaagacatgtcctaaatgttaaatggtaaggaggggtagggtgaaaaaagggaacatggatgccaggcagaagaaataaaagcctttccaaacatttgtatta

SEQ ID NO: 52702 - DNA, 756 bp, Homo sapiens
gccaggaccatgcaatcggaacgtgggcttgataccaagtgacatctaacaggtccagtaaaagaggcctacacaataaaggcagcatgtgagaaaggctgactctggaacatcaggataaactgctatagttttccactattgagctgaatttcgtatcaccatcaaaagttacctacctacaagtccctagtagagaaaatttaacttctggctttaaaaaagggacagaaaagcaggcagatctgctagtaagcaaactacagctcccccgaggagacacacaggcagtgggtaagaggaacagacccatggctccactgaagacacagagcagcagacgaaaaagacatgtcctaaatgttaaatgaatgtgacagaatgataccaggtgacttctaagactacatcatacaaagcaacacagcttctgctgggctctccctctctggacacgtgtctttgaagccctgagctgccagattaaacagtccggcttgcctaaagtcaccacgctggagagaccatcagggatggagaggtgctacagaaaccctagctattctagtccccagccatttgagtcttcctagcccagactcataagtgaagaaaccttcaagatgattccaatacctcctatcacttgactgcaacctcgtgaaagcctaagccagacctgcacggtggagccattcctaaattctggtcccacagaaactgtgaaagataataaatgatcatcattgctttaca

SEQ ID NO: 52703 - DNA, 225 bp, Homo sapiens
ctgtttttcatattggccacaccaatttttcattcccgtcaacagtatacagcagttcttgttgatcaaatcactgtggttatcattcagtgatatgcccttgatatagagatatgcaatatgtgcctgcctcaggtggcccatgcttattttgttataattctttccaaataattttaaaagatgatttatttacaagaaaaaataccttacacttaaaaactg

SEQ ID NO: 52704 - DNA, 1414 bp, Homo sapiens
  misc_feature (327)..(327): n is a, c, g, or t
tctcataaggacacagtcatgttggagtaggacccaccctcatgacctcaccttaacttaattagatgtgtagtagggtttctacataagttcccattctcagttcctaaggcttaggactcagcatgtctttggggggaacacaattcagcccatgacattgttatgattattctcactttgcatattatttagactttgcataagttgctcagaatcatagagtcaataaattgtggaatagagacgcaaacctaacgacttcagtttgaagtcacaaattcttaaatggtggcatcaaaatatttcagctttgatttttttttnaaagagtgtaaattattgagaagagtttcacaaaaaatggttatttctcttagactgtggaaattgtactacattccacgtctgagtgtgataaacctggacggttattcagtcttaccatcatacttttgcttgaggcccatgtgtgatccttcccctgccccaacaccacccaaggggccgagcccactcctccatgtggggtccctaggggacagctctctgcaaacaccccgagcacactgatgtgcctgtcttccccagggaagcaggagttccagctcaaaacccgcgggccacgggagcacatcctgaacttggggtggtgacgaaacatggctgtgctgtccaccggcttggagatctggtggatgttagtgtaaaccagaaaatttaaatccatcaaaaaaaggaaccgacattacctcaatcaggcaatttgaatcctagagagataggcaggctgaaagaacctacatttctacaatgctgaacccaagtagagattatgaactgcggcaccattcttagtgtgtttctctctccttttatttttaatttaatttaatttatttatttatttatttttgagacagagtctcactctgtcgccaggctggagtccagtggctgatctcggctcactacaacctccacctcctgggttcaagcgattctcctgcctcagcctccggagtagctgggactacaggcgtgcactaccacgcccagctaatttttgtatttttagtagagatggggttttgccatgatggccaggatggtctctatctcttgacctcgtgatccacccacctcggcctcccaaagtgctgggattacaggtgtgagccactgcacctggccttctctctccttttaaggattgtactcaggattacaagatactgcacatcaaaaaatgaatcccaatatgtggtcaattgaggaacttgaaaatgtcatgccaataataaaagcttgcgcacaataactgaagttagaaggaggtaaatattgctaaaatattgcggatttaaaaagataatctaaccctttattattttatgtgagtctcatgttccca

SEQ ID NO: 52705 - DNA, 677 bp, Homo sapiens
gggcaactcaccctcactcagaggtcttctggttctggaaacaactctagctcagccttctccaccatgagcctcagacttgataccaccccttcctgtaacagtgcgagaccacttcatgccttgcaggtgctgctgcttctgtcattgctgctgactgctctggcttcctccaccaaaggacaaactaagagaaacttggcgaaaggcaaagaggaaagtctagacagtgacttgtatgctgaactccgctgcatgtgtataaagacaacctctggaattcaactcccaaaaacatccaaagtttggaagtgatcgggaaaggaacccattgcaaccaagtcgaagtgatagccacactgaaggatgggaggaaaatctgcctggacccagatgctcccagaatcaagaaaattgtacagaaaaaattggcaggtgatgaatctgctgattaatttgttctgtttctgccaaacttctttaactcccaggaagggtagaattttgaaaccttgattttctagagttctcatttattcaggatacctattcttactgtattaaaatttggatatgtgtttcattctgtctcaaaaatcacattttattctgagaaggttggttaaaagatggcagaaagaagatgaaaataaataagcctggtttcaaccctctaa

SEQ ID NO: 52706 - DNA, 583 bp, Homo sapiens
gggcaactcaccctcactcagaggtcttctggttctggaaacaactctagctcagccttctccaccatgagcctcagacttgataccaccccttcctgtaacagtgcgagaccacttcatgccttgcaggtgctgctgcttctgtcattgctgctgactgctctggcttcctccaccaaaggacaaactaagagaaacttggcgaaaggcaaagaggaaagtctagacagtgacttgtatgctgaactccgctgcatgtgtataaagacaacctctggaattcaactcccaaaaacatccaaagtttggaagtgatcgggaaaggaacccattgcaaccaagtcgaagtgatagccacactgaaggatgggaggaaaatctgcctggacccagatgctcccagaatcaagaaaattgtacagaaaaaattggcaggtgatgaatctgctgattaatttgttctgtttctgccaaacttctttaactcccaggaagggtagaattttgaaaccttgattttctagagttctcatttattcaggatacctattcttactgtattaaaatttggatatgtgtttca

SEQ ID NO: 52707 - DNA, 709 bp, Homo sapiens
gggcaactcaccctcactcagaggtcttctggttctggaaacaactctagctcagccttctccaccatgagcctcagacttgataccaccccttcctgtaacagtgcgagaccacttcatgccttgcaggtgctgctgcttctgtcattgctgctgactgctctggcttcctccaccaaaggacaaactaagagaaacttggcgaaaggcaaagaggaaagtctagacagtgacttgtatgctgaactccgctgcatgtgtataaagacaacctctggaattcaactcccaaaaacatccaaagtttggaagtgatcgggaaaggaacccattgcaaccaagtcgaagtgatagccacactgaaggatgggaggaaaatctgcctggacccagatgctcccagaatcaagaaaattgtacagaaaaaattggcaggtgatgaatctgctgattaatttgttctgtttctgccaaacttctttaactcccaggaagggtagaattttgaaaccttgattttctagagttctcatttattcaggatacctattcttactgtattaaaatttggatatgtgtttcattctgtctcaaaaatcacattttattctgagaaggttggttaaaagatggcagaaagaagatgaaaataaataagcctggtttcaaccctctaaaaaaaaaacgaaataaaaacaacaaaaaaggg

SEQ ID NO: 52708 - DNA, 323 bp, Homo sapiens
agataccaagggccaactgtatactttacacacgtatgcacacacacacaatcacacacacacaatctgtatgatgatttggcctggagttgtagacatcacagatcaaaagtggcctggtgctagctgtttgggtatatccttgaaaagggcaactttgtcatttcctagagtaacctagagagagatttccaagcatttccccatgaacagaagtggtaaatgctgatttattgtgccatatgtgtgtttgggaggaggggagatagcgtcttgttttgaaaaaagttctcacttcataaaataaactgcacaccactcca

SEQ ID NO: 52709 - DNA, 338 bp, Homo sapiens
tctattaaaaaataatgtcaaaacacacacacacacacacacacagacacacacacacacacacaatcacacacacacaatctgtatgatgatttggcctggagttgtagacatcacagatcaaaagtggcctggtgctagctgtttgggtatatccttgaaaagggcaactttgtcatttcctagagtaacctagagagagatttccaagcatttccccatgaacagaagtggtaaatgctgatttattgtgccatatgtgtgtttgggaggaggggagatagcgtcttgttttgaaaaaagttctcacttcataaaataaactgcacaccactcca

SEQ ID NO: 52710 - DNA, 253 bp, Homo sapiens
tgatgtctacaactccaggccaaatcatcatacagattgtgtgtgtgtgtgtgtgtctgtttgggtatatccttgaaaagggcaactttgtcatttcctagagtaacctagagagagatttccaagcatttccccatgaacagaagtggtaaatgctgatttattgtgccatatgtgtgtttgggaggaggggagatagcgtcttgttttgaaaaaagttctcacttcataaaataaactgcacaccactcca

SEQ ID NO: 52711 - DNA, 1145 bp, Homo sapiens
tatgtctatgttttgagatagaatccttctattttatagcagggatgggcaaaccacaagcaaggggccaaatccagcctgctgcctgtttttgctaaaaaagttttattggaacacagccatggccattcacttccatatcatccaatggctgcttttgtgctacaattgccaccatgcccagtggggcctgtggcacacaactgcagaagtgagtagttgtggcagaaatcacttagccttcaaagcctaaaacacttactatctgaccctttccagaaaaagtttgctgacctctgttttagagatacaaactaacatacttacagataagtgatctgaatatgaagcaaattttcaacataatctgggttgatggggaaccgtgttacatataaacaaatccagagctgatcattgccaggtgagggctgtgcagacgatcacgacactattctcttttgcatatgttttccataataaaaagtcttttgaaaaaatcaatgatttaggggtttaaatatactgtagtcactttggaaaacagtttggcagttcctcaaaagttagacatagaattaccctatgacccagcagttccctttctagatatacccccaagagaattaaaaacacacattcacacaaaaacctgcacacaaatgttcacaggagcattgccttaatagcaaaacaagcgaaacaacccaaatgcccatcaggtgacgggtggataaacacagtgcggtctgtccatacatggaatgtgactcagccacaggcaggaatgaagcgctgacacacgcagcaacacggatgaaccgtgaggtcacggagtggagtgaaagataccagtcatgaagtcacacaccgtatgatgccattgacatgaagtgttcagagcaagtaaatccttacagatggaaggcagagcggtgactgccagggactaggagtggggggccagggggtgactgctaatgggtatgggatttcatttcggggctggtggaaacgttccggagccagagagtagtgatagctgcacaactctatgtatatgctatgaatcaccaccgaatggtatatttttaaaggacgaatttatggtatgtaaattgtgtctcaataaagctgctatctta

SEQ ID NO: 52712 - DNA, 403 bp, Homo sapiens
aattcattagggtggttcagccggctgtcactatcctgacagtaggcaggaatgcaaaatccactttttaaaatagcctcattggtagaggaatattggcctcacctaacacccatttgggctatcctggctggaaatgcactggcccacatctttatttgcatcctccaggattacaggacagtctcatttttcaggtggcatcatcacggctcataaattgaacaacacttccattagattgcgctaggcatcatcttcaaaactctaacatctggatgtttccaaatagcctgctatgtagatgattgatggctttcattcttggttggattctgatataggccatagctgttgggattggaattggtggtcctgatgtgccagtatgtgatcaactgat

SEQ ID NO: 52713 - DNA, 617 bp, Homo sapiens
gcttacaacgctccatgctgtcctggaccctagcatcacccaggcctaggtaatagaagggtggcttttgtaaagcgactcaaggctgagaagggaacagacactcttagcacaataagctacaggctgaaaaacagccggaggtgaatctttgcagcgtgaatggtctggctgtcttttataaaagtaactcgattggactagaccccatgagggactctgctcctccgctcccctttccctgaggacctaattccccactgggtcagccgcagaaccagatagagctggggactcacgacccgtgctgacgactggatgcaagaggaggaaggactttggtggagagaaggaatcaaaaggaaccaagaatgtgagacaagaggacttgctggtggggtcccctgctgtgtccccagagtcccagcatgtgcctgacacacagcaggtgcctgattgatagtgacggttccccaaaggctgctggagtcacctctgggattctgcacaggctccaccctctggggaggtgtgcttggtagaggacacgaaggctgcttgttggggttaccttagtacctgggtgaagagtaaaaagtaattaataataacgaaag

SEQ ID NO: 52714 - DNA, 279 bp, Homo sapiens
gagaatcacttgaacccaggaggcggaggttgcagtgagccaagatgcgccattgcactccagcctgggcaacaagagcaaaactttatctcaaaaaaaaaaaaaaggtgaaagaataaaaagctgatgggccttgaaagaaggctatgataaggacctcacagagaatttagaaatggggtgaagcaaatgggatctgttgataagctattggtatcacactgatttcaaatattttcttcaatgcttgtattaataaattaacagtgaactcaaggg

SEQ ID NO: 52715 - DNA, 863 bp, Homo sapiens
ttgaagtaaatcccacatattaaatcactataaatatttcagtatattcaaaaggaaaaaacttttttcaaagcataaccataataccattttcatatcttaaaagcctttctatttaagaatatttagttgtaaaaatttccagaagttgtgtttatcatgaattaaaatgtggctttagtgaaaatacagttccttggtatactctcccagcaattagggagagattctgtccaccagcagaatggcctgggttacagcttttatcaaaatctgctgtctgagggtcttagttggaagaaataatctcctatttgagttcttcgaggccgaaagattgataatgactgtatggccgatctctaactatatattgttgcttttttaccttaattaactcttaagctttgtacgtgaggaagaaattccaaggacatatcacaagaagaattatttttcagatttcgccactagccgaagccacggatgggaatgtggtggtggagctgttccactcagatcttctgtgagggatttctgaaggtcaagtaacattcttacgtgtaatttcctgcattgggactttacaaagcttctaagaaaaccaacatgttgattttgcatttgtttttaagaagatgacttcagaggaaagaatacccctgatatcagagatgaacctaaaggcagaatggacagtgcttattctattttcttcaagcagcacattaagtggattacttgactgttgatgacttaaaaggatgattaatactcttgatgttttaaatattgtcttttcttggggtttcacttgatctttaaaattaagtgagatactagccctgtctcaaaaactttat

SEQ ID NO: 52716 - DNA, 635 bp, Homo sapiens
  misc_feature (627)..(627): n is a, c, g, or t
  misc_feature (629)..(629): n is a, c, g, or t
gtactttcaccaatcccccgaccctcctcatcacacacaacttcctcctccctaccagggcaccgaagtgtaccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctctnanttcctg

SEQ ID NO: 52717 - DNA, 1747 bp, Homo sapiens
  misc_feature (31)..(31): n is a, c, g, or t
  misc_feature (60)..(60): n is a, c, g, or t
  misc_feature (488)..(488): n is a, c, g, or t
  misc_feature (1739)..(1739): n is a, c, g, or t
  misc_feature (1741)..(1741): n is a, c, g, or t
gctaccaccatgctggcctcagggatgcttntggtggccttgctggtctgcctgactgtnatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgcccnccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagggcaccgaagtgtaccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaaggggctcagttcaccttgataaggtgcttccgagctgggatgagaggaaggaaacccttacattatgctatgaagagtagtaataatagcagctctnanttcctg

SEQ ID NO: 52718 - DNA, 892 bp, Homo sapiens
atccctaatccaaaaggccaaaatccaaaatgcttcaatgagaatttcctttgacatgtaagcgctgaaacagttttgggttttggagcatttaggattttggttttcagattagggatactcaacctgtatttttcttttatacttgaattcttcaaaattttctttcgtgtgttttgttgtatcactttttcttagcacaattacaaaacaaatgtaattatttcacatttttcactctcttatgggatgcatgtactggaattacttctggggacactattccttcctttgtattcctggtcctaaaaaccaggtcagggtgttcacaagttacagactggtttctatgcatgacagaatcttttgctgattttattcctaaatgatagaatacggaagttaaaaaccaggtgagaaaaccaggggaggagctgcccaacagcatgcacttgtctcatggtggagctctaggcactcagggtgggtttttctcagaggtgggaaagtcaccatttgaacctaatgctactagatgcagtggctgaacatgtgggactatgagggcattaaggagtcaacaggtgacttccaatggactgtactaggcagcagccacatttatacgcactaaaagcaggatttatttttcctctcacttgcgtagcaatctcggtttccattttaatatttagaaggtaagttcagttgatggacactttgtgtaataaaaggctcttttaaagtacaagcttatgcacacacacaggataaaaagtggcacttcctgtgcccatggctttcatggagtacatttgtggagcccaaagcttagtcctggatatgtttatagcactttagctccgtttgtgagtttggaacccttccaaaa

SEQ ID NO: 52719 - DNA, 211 bp, Homo sapiens
gctgctgtgctgggatgtgtgcagtactaatatgggaatgacagtgagtggacattgcatcacatagtagcctttcctcctaggaggcaaagcactcacctccccatcaccctgcagttatcctcatgggggagggagccagtccagtcccttgggaaggcagtgccagggccaggacctgaacctgcctttctgatctacagcagagtca

SEQ ID NO: 52720 - DNA, 6951 bp, Homo sapiens
cgtggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgagtttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttcttttccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacacttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtgcacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttccccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaacgtccgcctcccg

SEQ ID NO: 52721 - DNA, 5985 bp, Homo sapiens
cgtggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgagtttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttcttttccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacacttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtgcacatgatgctctcatagttgcacagaaaaggcaataatgcacatgaaaaccc

SEQ ID NO: 52722 - DNA, 8301 bp, Homo sapiens
  misc_feature (3428)..(3428): n is a, c, g, or t
  misc_feature (3717)..(3717): n is a, c, g, or t
  misc_feature (4443)..(4443): n is a, c, g, or t
cgtggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgagtttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattanacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctangacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccangttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttcttttccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacacttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtgcacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttccccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaacgtccgcctcccg

SEQ ID NO: 52723 - DNA, 401 bp, Homo sapiens
gacaatggatagcccccttcctttatcaacccattgaaaaagagactcaaaccacttttatcttaatgaaatgaaaagcacaaatggaaaaaagttatctttgctttatatgcaattgtattaaaatgttgaaatctacaagcaagataattaaaatgctatccctgccaatcagctgagaaatcagtttaactggggtttgacttcatgacaaatgggccatcaaactaaaacttagcagaactatggcagcctgagagttccagagtggaatttggccttagaacatttcctaagtgcgagtttggggcacagccagccaaagaggctcggtgacttgtcactccagagaatgcctgcagtgtcctcaccctgtcacagcctcaggacacattttgaat

SEQ ID NO: 52724 - DNA, 469 bp, Homo sapiens
ccagtacctatgaccctgggactgggccctggggacaggagactgacccttggtctgagggggtaggatagttggaagggtgtcaaggtgtttgtggtccatcggtctggctctcaggaccatgtggacctcaagcgtgtctcctcccccgccctctgggctccccttccctgggcgcagtctgtctcttccaagttcaccacttgtgtctctgctccagcagctgtggctgggtgcggctgccaattaagcaagtgggactgtaagtgacaggctaaaattaggtgtatcgacacccccagttctcctttcattggggttgttctgagccttctagactgtaagttgacagtcacctgccaagcttgaggagcgggtgtggggcagggcctcctgggaatgtgagtttgggaagttcttggttactggctgctctgagtggggtctgtgtgtgtgcgtgcctgctgct

SEQ ID NO: 52725 - DNA, 385 bp, Homo sapiens
cttactttccttttgattagaaaaaagtaaatttcaacattcaaagacagagcacatccctctccctgaaggaaggtgcaaagtcccagcctgacttgagtgtttgaaatttagaagggtggctcctgttggtcctagaattgtgcggctttcttgactgcctggaatacagacctttccatcaggaaagcctcaaagctggttctccaggttgtatgcctagcacataccaaataccatgttgtagcagagaaaacttagcaaggactttgaatggacatttaatgttatttcaggcaaggcccatggctcacacttgtaatcccagcacttttggaggctcaggtgggagaggattgcttgaggccaggagtttgagaccagc

SEQ ID NO: 52726 - DNA, 520 bp, Homo sapiens
ggacttgtatgttttataatgagtctcccatttgcggggcataactcagtttcaaaatcaacatcattttaagcttggtgtgcttctgtgatcccagttaagacaggagaatcacttgagctgaggagtttgagaccaacttgggcaatatagcaagaacctgtgacaaaagaaaaaaaaaatccttgtgtgtgtatatacacacacatactttatcatacataaacgcacatgcatacagtcatgtgctgcataatgacattttagtcaatgatggaccacatatgtgatggtggtcccataagattataatggagctgaaacattcctgtcaactattgactttgtagctgtgctaatgtcatagcacagtgcattactcatgtgtttgtggtgatgctctgcatcaaacaaacctgcacttcgagtcatataaaagtataacacatacagttatgcacagtacataatacttgataatgaaaataaatgactactggtttatgtatttactcatact

SEQ ID NO: 52727 - DNA, 309 bp, Homo sapiens
ctccaacctctgcctctgccgtcccatggccattttctctctgtgggcctctgtctccaaatctctctctccttataagaacaccagtcatggccaggcacagtggctcatgcttataatcccagcatcttgggaggctgaggcaagtggatcacttgagtccaggggttcaagaccagcctgagcaatgtggcaaaactctgtctctacaaaaaatgcaaaaaatggccaggcatggtggcaagtgcctatgatcccagctattcctgaggctgaagtgaggatcactgagcccaggaggcagagtct

SEQ ID NO: 52728 - DNA, 351 bp, Homo sapiens
gcctcccaaagtgttgagattacaggcgtgagccactgcacctggcctatcttttgaagtatttccgaagtattatttcttttatctcttgaagcaaaggaaactgcttcataagttttattagagggcaaaatcttttattgtattaaaaattgattttataaatgattttttagaagaaagcaacaatttaaaaaatatgtatgaatcttttttatgctctcagttgagaaaatctttaagattctaattcaggttgggtaccttgaatccaaaagctttctgaagtggaaggaactgcaaaaatgatttagttcagcaattcttagaatatagtcaatgagtgtcttc

SEQ ID NO: 52729 - DNA, 895 bp, Homo sapiens
tgtggctgctttttactaaccacagagttgaatagccatagaaactctacagccatttatggaaagtttgctgacccctgatctgaataatactaatcttggttccggctttgttgtacgtattctgttctgttgaatatcttattgccctcatgatcattttcagttaagaaggactgctacaacaggcatggaaacaaactcttatgggaccactaaccctgtctgccgtccaggcaacccttgctctctgctttctttagcgtgccatatccccttcccttcttttctctcgagcttctattccctcactactattgtaaatctctagagagcataaaaggggaaatttaattttcttttatcttttcctcctcctgaaaagtagaaaacagtcaataaacttatataaaatatttaaggtgagttttaatattattgtttttttttttgagatggagtctggctctgtcgcccaggctggagtgcagtggcatgatctcggctcactgcaactttcgcctcctgggttcaagtgattctcctgcttcagtatcctgagtagctgggattacaggcgcctggctaatttttgtattttagtggacacggggtttcactatgttggctaggtgggtctcgaactcttgacctcaggtgatccacccacttcggcctcccaaaatgctgggattacagacatgagccactgcgcctggcctattattgtctttttattcaaagtaatacctcataagacttaagaaagtttatagtattaaatctttgtggtttacactgaaatggatttatgttgctgcggattaactggagttttgatttaaaggcagaaatgtaagttttattgctaatctgtcatgagattagagttacc

SEQ ID NO: 52730 - DNA, 234 bp, Homo sapiens
ttggtataatcttgatacgaaaaccagacaaagatagcaaaagaaagaaatatttcaacttacaaacctagatgcaaaaatccttaataaatatcagcaaattgagtaaagtgaggtataagaacataataaataatgactaaggaggcatggatgattaagcatttgaaaacttttcttaattttctaaattaaaaattatgtcctaatagatacaaaaaaagttattctaca

SEQ ID NO: 52731 - DNA, 411 bp, Homo sapiens
agtttattatttttattttttgtagagaccgtgtctccctatgtcgcccaggaaaaggaaactattaataagcttggacgaatatgcttcaactctagaattctgaaaaaaatcagaaaactaaaaacttctgaagctctatttgaaatctctcttcaaattgagttctaaagttcctgttgcttcagacaatggatgagcaatcacaaggaatgcaagggccacctgttcctcagttccaaccacaggcagaggagaaggagaaagagaaggagtttcttgctgtctcatggaagggagaagtagaagaaaatctacatataagtggatctgcacagttcaaacttgtgttgttcaagagtcaattgtataaacgagtaattaaaagcctgtgtgatccaggacccaaca

SEQ ID NO: 52732 - DNA, 1132 bp, Homo sapiens
  misc_feature (926)..(926): n is a, c, g, or t
gtttacactcctgacagcggcggcagcaggaggaggatcgggagtcgcgggaggatgggccgccgctaggctcgcactccggacgcgcctcgcagtgcgcagggtgggtgccccgcgcctgcagcgtccgccggggcggcgcggcgggaggtggccgacaggctccgggcctcgcagcctcagcccccggcccagcgcgctttccgacggcggcgccgcgccgagccacccgcccgcccaaggtctctcgcgggcgggagaacggaaaactcccaacttcctgagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgtttggaagtattttgttcagctttgcagtgcattggaacacatgcattctcgaagagtcatgcatagagatataaaaccagctaatgtgttcattacagccactggggtggtaaaacttggagatcttgggcttggccggtttttcagctcaaaaaccacagctgcacattctttagttggtacgccttattacatgtctccngagagaatacatgaaaatggatacaacttcgaatctgacatctggtctcttggctgtctactatatgagatgggtgcatttacaaagtcctttcaatggtgacgaaatgaatttatactcacggtgtaagaagatagaacagtgtgaataaccagctcttccttcagatcactattcagaagaactccgacagttagttcatatgt

SEQ ID NO: 52733 - DNA, 1144 bp, Homo sapiens
  misc_feature (1038)..(1038): n is a, c, g, or t
  misc_feature (1144)..(1144): n is a, c, g, or t
gtttacactcctgacagcggcggcagcaggaggaggatcgggagtcgcgggaggatgggccgccgctaggctcgcactccggacgcgcctcgcagtgcgcagggtgggtgccccgcgcctgcagcgtccgccggggcggcgcggcgggaggtggccgacaggctccgggcctcgcagcctcagcccccggcccagcgcgctttccgacggcggcgccgcgccgagccacccgcccgcccaaggtctctcgcgggcgggagaacggaaaactcccaacttcctggaaaaggaaactattaataagcttggacgaatatgcttcaactctagaattctgaaaaaaatcagaaaactaaaaacttctgaagctctatttgaaatctctcttcaaattgagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgtttggaagtattttgttcagctttgcagtgcattggaacacatgcattctcgaagagtcatgcatagagatataaaaccagctaatgtgttcattacagccactggggtggtaaaacttggagatcttgggcttggccggtttttcagctcaaaaaccacagctgcacattctttagttggtacgccttattacatgtctccngagagaatacatgagatggctgcattacaaagtcccttctatggtgaccaaatggacttatacttactgcggaagaagtttgaacagtgtgactaaccaccctctn

SEQ ID NO: 52734 - DNA, 1032 bp, Homo sapiens
  misc_feature (926)..(926): n is a, c, g, or t
  misc_feature (1032)..(1032): n is a, c, g, or t
gtttacactcctgacagcggcggcagcaggaggaggatcgggagtcgcgggaggatgggccgccgctaggctcgcactccggacgcgcctcgcagtgcgcagggtgggtgccccgcgcctgcagcgtccgccggggcggcgcggcgggaggtggccgacaggctccgggcctcgcagcctcagcccccggcccagcgcgctttccgacggcggcgccgcgccgagccacccgcccgcccaaggtctctcgcgggcgggagaacggaaaactcccaacttcctgagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgtttggaagtattttgttcagctttgcagtgcattggaacacatgcattctcgaagagtcatgcatagagatataaaaccagctaatgtgttcattacagccactggggtggtaaaacttggagatcttgggcttggccggtttttcagctcaaaaaccacagctgcacattctttagttggtacgccttattacatgtctccngagagaatacatgagatggctgcattacaaagtcccttctatggtgaccaaatggacttatacttactgcggaagaagtttgaacagtgtgactaaccaccctctn

SEQ ID NO: 52735 - DNA, 618 bp, Homo sapiens
catagctggacctagattgaaagagtaaagaaaaatacttattaaccaacccagtataattaagaagtttgtctgtaaatactagaacaattggtagaaaaaacaaatacatattctcccctgagaatctgtaacatcaggattatccatcatgtgttgtttgacttcaaacttttaaattatacagccttgaaccatgaaccatcaaattaacaaattaacatatagattattttctggccattgatacactggaagtttggtggaagagatgcaaaatcattccagagcaaaagctgaaaatttttttctgcaaagggcaagataataaacatcttaggcattattgaccattttaaagagcagcttatagtcaccaaaaggaatatcaacaaactagaaagtgaagatgaagaattatccagaatgcagaatatgaaccaaaagatagaacataagataagctgaaagccatggaggattgaataaaactatccaaggaatatctaaaagaaattctgaaaagagaatagtaggaataaaaataatgggattataatagtttgcttctacttctgggatgaatgtagtagttgtataagacacatactcttatta

SEQ ID NO: 52736 - DNA, 546 bp, Homo sapiens
ctgatacactcccaaagacaatgagggctccctatgtgcagactaaagttttttagttagatacacatattaactagatcacttaaacaaagattaggccttgtccacagcctattcaagaatagaaaatatgcttatttatagctcaataatttcattattcctgtatgggtttttcctagatagaaaagttgagtaaatttatttttaaatagtatgtatatactcacacacaataatttaacaaacaaaacatgtataaaaattcaacaaaagttttataacataaaagattatggtggctggatgtggtggctcacgcctctaatcccagcactttgggaggccgaggcgggtggatcacaaggtcaggagttcgagaccagcctgaccaacatggtgaaaccttgcctctacgaaaaatacaaaaattagctgggtgtggtggcacacacctgtaatcccagctactcaggaagctaaagcaggaaaattgtttgaacccgggaggcggaggttgcagtgagccaggattgcaccactaca

SEQ ID NO: 52737 - DNA, 813 bp, Homo sapiens
aacaacggctgttctttaatacgtttatgttccctaccaaaacattcctcactcagtactgctacccagttaaagatttgactggtcggtgctgcagtcacagagaaaatgaattggctgatctgacgaaaaatttatcttctaacctaaggcatgacagagtcagataaatgggccctttccactaccaagaacatgatcaaagttctgcttttgtacattcaaccatggcttatcccttctggcaggcatatttcctactggaattttcagtgtctcacacctgtggtcttccacctctcctcctgcttccctactgctgacgagtcccctatgtcccctgggtaaccttatttcctctcacgtagcaatcacagatagagaagacatacggttcaggcgcacgattcccagtccaaaattccaaatccaggaagcaagattcggcagcaaaacctattttgaacagacactaggctgttgatagtctctgtttactccattcagtatgatattcacgtgttttgctgtggggatattattgtatttcattatagagtattatctcaggccctgctggaggtattctgtaataatacacagtatttggatttttaaaaatgtgaatcttcaagttgaatgaggaagaatctttttttaaaaagttttgaagcctgaaacacacgtggcctcaagggtttgagatgagatagggggaagaagccatccctgtgagaactgtagccctccgcagataaggacctctgctgctgtccccggcaaatgtagataaagccattagcttgcacccat

SEQ ID NO: 52738 - DNA, 3531 bp, Homo sapiens
aggcggccggcgcagggccgcgagaggcttcgtcgccgctgcagctccgggggctcccaggggagcgtgcgcggaacctccaggcccagcagttatgaaagaaaaaaaattacattatcttgaagaactgcaggagttgagtattccagaaaatgcaatgaaataggtcagctacttgattttaaaagtcaaatactggatcttttattaaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaaccagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaactgtggggtgtgacacacaagtgactgaacacttcctggggagctacaggggcacttaacccaccacagcgcagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcgtctttcaaaaaa

SEQ ID NO: 52739 - DNA, 3411 bp, Homo sapiens
aggcggccggcgcagggccgcgagaggcttcgtcgccgctgcagctccgggggctcccaggggagcgtgcgcggaacctccaggcccagcaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaaccagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaactgtggggtgtgacacacaagtgactgaacacttcctggggagctacaggggcacttaacccaccacagcgcagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcgtctttcaaaaaa

SEQ ID NO: 52740 - DNA, 2418 bp, Homo sapiens
cccggtcagttctcctctcaggagaagctttcctgccggcagtgcccggcgctcactggttattcgcctgacggtgaatgatggttaggactggaaaccaggtctcgatgcccacgttcgctctcctcgggcagcagaaaccttgttctgatttattcctcgcagtggcgcaggtgacaggagagttaggtgccgtcacaggtcagagatctcatgcagggtcgttagggcccagccctgcctcccgttagggaggcccagctccgcagccacacgcgaggtggaagggcagtgcacaccttttacttggacatgaagcatttgtttcctgtcttgcagtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaaccagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaactgtggggtgtgacacacaagtgactgaacacttcctggggagctacaggggcacttaacccaccacagcgcagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcgtctttcaaaaaa

SEQ ID NO: 52741 - DNA, 1622 bp, Homo sapiens
aggcggccggcgcagggccgcgagaggcttcgtcgccgctgcagctccgggggctcccaggggagcgtgcgcggaacctccaggcccagcagttatgaaagaaaaaaaattacattatcttgaagaactgcaggagttgagtattccagaaaatgcaatgaaataggtcagctacttgattttaaaagtcaaatactggatcttttattaaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcggtgagtaggagcgcgagggctggggcgcgtgagggccggggcaggggccgtcttgagccctgtcgagggcctcttgtttttccaccaacgccttcgttgggctggggatggtgcttcactacctcgagtttctagggaaggcagaagccagtgcggggctggcgacatcacagccccagaagaccggcttctgtggaaggggccgggcctgcccgccggggcctcttctgagatggtgtcagggtcggagtgcggcctccccgccatcccagacatcgaccgtggccgcgctgcgctgtgggtgacgcgggaggacagcgggctccctggagagccg

SEQ ID NO: 52742 - DNA, 355 bp, Homo sapiens
gatagggggaagaagccatccctgtgagaactgtagccctccgcagataaggacctctgctgctgtccccggcaaatgtagataaagccattagcttgcacccatcccggctgtctcgcaggctgccggctgttcgtttgtccctgccgctgatttgggtgtgctgactctgcttcattccagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccaggtacgcgccatggctggggcgcc

SEQ ID NO: 52743 - DNA, 575 bp, Homo sapiens
  misc_feature (27)..(27): n is a, c, g, or t
  misc_feature (41)..(41): n is a, c, g, or t
cctctaaaactaatgatcccccggctngagaaattcgcacnatgccaagtgcacgggcctcctcgcctcccttaagcctgggaaggcgctggcaggccacttctgcgcctcgtggctggagagctccggacggtgccgtggggaaccgggtaccagtcccggctcccggggccactttgcgaaccacctcctacgcagagacggggccgggagttcaccccgctgccgctctccagcacaccggactccgcgggaatttcagcagcgcactctggcgtcttctcggctttaggccgggttggggctacgggatgaaggcggccatcgggccagagtcggcatgctgttctgctggtggtttgagccacccgtatcctggacaccggccaggcggtcccttcactccctgcctcgcttccctctcttcacggagcctcgaggcccagggacttcagcagcatcaggaggggctccggttttccgggcctgaggacagacactgagacatcgcctataattagcaacaataatgcccgtgatggtagtaattactaataaccagctccgacatcggg

SEQ ID NO: 52744 - DNA, 713 bp, Homo sapiens
aaaaacaattagtaaaaattatgcattaaggaattatttactagactttctggaagtaaaaaataagtcagctggttttccctttgaattcctatatattaaggcagaattctctatactgtccaccaaaatcatagttacaactgtttacttgaaatgatttatatactgcattgacctggcatgttaatattttcctataaatatcaccacttatccccatgccctaaagcagtttttttaaacccattctttcttggagaataattataataccttaaatatagaactttgggtttctgatcttgccatagccatgtagcacagccactgatttttagtaagctgtccattcctgtacttttcttaatttgctaggtagaagctagaacgagagagaacaaatgtctttttctagaagctagaaaagaaggagttcttcaaaactcccacagaataaaatgtatacagaatagaggatttgacctagcacttgtcagagagaaagatcatcaccaaaaatgtctaagatggaaaaagaagttgggggctgtttcactgacctcatttgctgttctctactggatgtttgtgtttagggaatggttatttttatttctattttacaccatttttcagcttcaggcacagcgtatgcgtcttacagtgcaccatggctgaataaatatgagaagcattttctaaaaaaaaag

SEQ ID NO: 52745 - DNA, 305 bp, Homo sapiens
gaatttgcatatgcagatgctcttcaacttctgatgggattatctcccaataaacccattgtcagttgaaaatattggaagtcaaaataaatttaatacccagataaacatcataaagtcaaaaaattgttagtcaaacaattttaagtgggggatcgtctgtagttaaataggaaaatgttattttcatgagttttcatttaatttttttttaagatatagactcaacaacactttcatttatacaatgaaatgttagtacccattttaatagaattcattttcagtttcttttatcctttacc

SEQ ID NO: 52746 - DNA, 295 bp, Homo sapiens
cagcattatctcctacccatttatctcttctgtagcatgtaaagatttagaatggattggttcaaccaaaagttatagttaggaaaaaattctgaaaaacctcaaaatgaaacaatgtctatagtggctgcctgaccacttctcacccttcctctttgagagaactctgtcagagcagaaagttggcagccagcagaatagataaggaaaatttagtaccatccttacaactgaagtcctatttgcctgctgctctgcagattcagccccaaaatataggaccaaatctggtaca

SEQ ID NO: 52747 - DNA, 927 bp, Homo sapiens
agcacagcagcaactgactgggcagcctttcaggaaagatgcagccactcctgcttctgctggcctttctcctacccactggggctgaggcaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaagcaatataaatgtcaccctgggcgcccacaatatccagagacgggaaaacacccagcaacacatcactgcgcgcagagccatccgccaccctcaatataatcagcggaccatccagaatgacatcatgttattgcagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataaccaattcctcatttgttcattaaacgtcattcagtacttagt

SEQ ID NO: 52748 - DNA, 499 bp, Homo sapiens
cattctcctggagaagggagaggtaccttgactcagattgggctggagacagtaattaaggcagagctgaagtccagcgaccgaaaagatccagaggcttggctcctgtaccccaccgatcttccatctcacacacacccagcaattgaaggggcccacccacccctgccttccctgagagcccggagctcagggaagcaggagcagggaggcctgtctcagtctcccttctcctctctacctacagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaata

SEQ ID NO: 52749 - DNA, 338 bp, Homo sapiens
gtgaggagctaaggaacttcctggccagccaggaacacagccctgcggagctcttcggtggaagagccatctgaaagaagagttgtagcaatgaaagggtgaaagaaagaccaagtgagtctttgcgggagggaacaggccagtgtaaatgaggaggaaaggaggataagatcaaaaagagcaagaggaagagatggaagacacatattggggctcaaaatataaactcaggctatttatcaacttaatctggggaagcaaacctgaaggcaagtaccaccctgtcatccctagctcagagctgctgagaaagaggatacagctgagccccagggccc

SEQ ID NO: 52750 - DNA, 884 bp, Homo sapiens
agcacagcagcaactgactgggcagcctttcaggaaagatgcagccactcctgcttctgctggcctttctcctacccactggggctgaggcaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaagcaatataaatgtcaccctgggcgcccacaatatccagagacgggaaaacacccagcaacacatcactgcgcgcagagccatccgccaccctcaatataatcagcggaccatccagaatgacatcatgttattgcagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaata

SEQ ID NO: 52751 - DNA, 310 bp, Homo sapiens
actggatgttttaataatgaaatattgataaatataaaagaataaaagtattatatatatatataaagaataaaacatatccaatatataaataaaaaattaaatgcctgtgatgtatcatgtaataaagttatacagtttgggctgtttcaagtaattccatataatgattcctcctagatattttctgattagcattcatcagttgaaagcagaaggaggcagctgatgattgtaaaaaaaaatggcaataataagatacctaatgaccccgaaaatgaagcgaattatgcctaatttaaaaacaaag

SEQ ID NO: 52752 - DNA, 346 bp, Homo sapiens
ttagaggtttaataacttaccaaggtcacatagtgaaatacagctggccatgattcatatgtaagtaatttgctgtaatagtctgtgctttcatatttttatattgactcatttcaatttgaattacatttctctaacatatttaatctgcaaaattcctagtaactgttataatctacttacacggattcacttataggatctaataggttaattataaggctgtggtgatgtgtgcctgtagtcccaattactcagaaaactgaggcagaggatcactagagcctaggagtctgagacagcctgggcaacatagcaagaccttacatcaaaacaaaattaaaaa

SEQ ID NO: 52753 - DNA, 513 bp, Homo sapiens
gaattcaggtttattatttttaacctaaaacattctctttggttcattcatcccctcatgtcatgggggctcattggttttccttctttgtcatatttaagtatgatttttcaacaaaacttctagaagtcagcttattatgtcaccattcatgcaaagtgctcatgcctctgattggtccattcactgacgtgacaatttcaggtcctatgtttaaaaagaaggggctggccgggcacgatggctcacgcctataatcccagcactttgggaggccgagaggggcggttcacgaggtcaggagattgagaccatcctggttagcagagtgaaaccccgtctctactaaaaatacaaataaaaattagccgggcgtggtggcgggcgcctgtagtcccagctacttgggaggctgaggcaggagaatggcatgaacccgggaggcagagcttgcagtgagccgagattgcgccactgcactccagcctgggcgacagagcgagactctgtctc

SEQ ID NO: 52754 - DNA, 141 bp, Homo sapiens
cagccatcatcttcacgacttcctgtgctacagtttaaatcaccaagccccgttgagagccacactccaaaatcactgtccaaggtacctacccttctgctacctttacgaacaagacagcaggcaagggacatgtgtttc

SEQ ID NO: 52755 - DNA, 2127 bp, Homo sapiens
gctggagtgtagtggcacgatcttggctcactacagtctccacctcccagatttaagctattctcctgcctcagcctccctagtagctgggactacaggcgtgtgccaccatgcccagctaatttttgtattttgaatagagatggggtttcaccatgttggccaggcttgtcttgagctcctgacctcacgtgatgcgcctgcctcggcctcccaaagtgttgggattacaggcttgacccaccgcacccagccagaatatacctcattcttaatgaaataagccacctaaactttctgcattcttttagtgaatttcacaaaactatttatattattattacgtattaatggaaagtttaaattttgcttaactagagttttctggattaaaagtattgctgacattcttatttcttttctaatagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaaaaaaaaa

SEQ ID NO: 52756 - DNA, 1506 bp, Homo sapiens
cgcacggcagttagtgggtaggcctgagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcggttgtctgctgcaggggtaccgagc

SEQ ID NO: 52757 - DNA, 1001 bp, Homo sapiens
tgatctagaggatcaccctttactctgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaaaaaaaaa

SEQ ID NO: 52758 - DNA, 591 bp, Homo sapiens
ctactactactaaataagcggccggtcgacgagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaaaaaaaaa

SEQ ID NO: 52759 - DNA, 663 bp, Homo sapiens
cggacgcgtgggtcgacccacgcgtccgcatcgacaaaagaaccattgaaaaatttgagaaggaggctgctgagatgggaaagggctccttcaagtatgcctgggtcttggataaactgaaagctgagcgtgaacgtggtatcaccattgatatctaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaaaaaaaaa

SEQ ID NO: 52760 - DNA, 2136 bp, Homo sapiens
cgcacggcagttagtgggtaggcctgagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaaaaaaaaa

SEQ ID NO: 52761 - DNA, 1567 bp, Homo sapiens
cgcacggcagttagtgggtaggcctgagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaagatcctaccaactatggatggaaaatacttgaaaaaaatacaggaagtttcaaaaagcaagtttgaacctgccatgtgctaagcactatgctgaatccatttgaactgaagaataccctgctatagcctcccattgtttcacagatcttcagtctctctctagcacccactgtttgagcagtgttcatctggcattttattcattggctacttgtgttcactctttgcttctgtgaaaaaaaaaagactcctaaaaatcaattatatggtgaaagaaatcccttacagactaagagagagcgtaaagtgctgtctctcaacaagaaaataaaattcttagatcttttgaaaagtggcgtgtgatttaccaaagtgacacaat

SEQ ID NO: 52762 - DNA, 718 bp, Homo sapiens
  misc_feature (2)..(2): n is a, c, g, or t
  misc_feature (22)..(22): n is a, c, g, or t
tnaatttatggagggcggaatnaacaagacggttcagattgatttagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaaaaaaaaa

SEQ ID NO: 52763 - DNA, 356 bp, Homo sapiens
ctggtgcttcctgctgccttttccaaagagattcccagatgaagagctggggagaccataaagggacagatttctgcagagccaggggacagcctgggcgaggtcagagtgccgggtttgggctgacagacattaattgtctcagcccagctcaacccagctttcctgaggtctgggtatttctctctctttgcagccacaatgccacctgctggccatcagtggaactgtagggctcgctaagcagagctgcagagtggaggttcttatcttacccgctggccttttgatcttacctgccctcctgtgccccgcctttcccctctgtgacacctcttcctgttgtctcatttcag

SEQ ID NO: 52764 - DNA, 2835 bp, Homo sapiens
tatgcctgtttttatgtttacctataattttcatatagccgtataaggattgatttaccattttttgcccaacatgacaattctggctatgaaaattatgtttaaactgtgtatgatctattttatgtgctctatgttcccatttgtttgtttggtctggacagtggttctggaatgaattctatctagtaaattagtaaatgtgctgttttgtataaagcatgataattactttttaacagaagttcatttttaaagattactcccttttctttctctctttttttttgagacaatttctctcttgttgcctaggcagtgcagtggcgcgatctcagctccctgcaacttctgcctcccaggttcaagcgattctcctgccttagcctcctgagtagctgggtcagccaccatggctgactcattttttgtatttttagtagagaaggggttttaccgtgttggccgggctggtcttgaactcctgaccttgggtgatccacctgcctcagcctcccaaagtgctgggattacaggcgtgagctatcccgcccggtccccttttctttattatcgaagatattgtttaaaagaaagaaaaagtaggtcccaataatatatgtgctattcaaaaaatgtgatcatttaggacattatcacaagttgctatggaaataactgaagacttcctcaggagaaggaaagaaaatgaggaacataatgatagagtcggggctcgatgcagctgaaatactgaatactgaaatactagaaaccaacaaaactggtttctagaattctccagggatttgggcttgggaaacttggtaagaatagtttttatttttgaacattcaactttggttcttcaaagtaatctttaaacatgggaatatgttttcaagacaatttataggacatacttatgtagttggtgaggtcttctcaaaagtatctacctttgttagataataacaagtgattaagaaaggggagatatggttttatactcataacaatttcctgtgccattctctgtacacagaggtgattcatttactctcccattagtagaacttgcactttgggctgtctgttctagtatttgggaagtgtttatgcttccttccagggaccatcttatgatcagaggcaggatgtctgtgagatggttagctagagttagcagtgtccggggagagtggctttagaccagtcagtaccttgctctttgtgcatggtgcatgtcaagtcaggaagccaagaaaccgttggcattaaaatctagatgcatagagatccttgctatgagttgtggataggagtggctccatctatccttgtggtgaaagagtccaggagctcctttagagattgtcaagtcctgagcgatgagctgcccttaatcctcagaagccttacaaaaattgagatgtaccatttctaccctttgagaaaaaagaaatagaaacttacttgatgcagaatggatatttatatttctgcttgcaccatttccatagcagctgacaaaggcaaaatcatgaaatagaatcatttctataaattgcttctttaagttttctctaaattttgcctctaggaaaaaattaaaactattcaatgacagctagctgtcactggtgctaccccaaagctttccaatcttttatgtattttttgtgaatgaaactgttgctgtaggaaagtcaaggttcatgtaagagtatcgtggtgtaaatataatggtttcacagctgtttgaatttttcttttcctgtgccagatatagaatgcagtcaaccctttttcagtaacttatgttcaccagtctgtgcttttcttctcccagaaggcttttcttagtggttgtaaatgcaagaatcctgagccctgtgttgcaaaggtgggtggtctgtcagcactttctggcaaattgagttgatggatttaagataagcctttggggttcctgtcagttttctgggccctgaggaagggttgggcctcctttactctcagtattttgagtgtttttcaaatgtttgtacgttatcttgcactgctctaataaaaatgaaagctctctgacaagaaatagttctggatggtttgaagatctgcggggaaaaataagtgtgcacctgagaccttcagttagtcttttatttatttagaataaaaaatagtttgataacctaccagagttagtgcttctttaaaaacactccttggaaagatggggactgtcccttaggaaagccataaaagtgattcccaatactttgcaattgcttttgatttttagtcctttggaacaaatgtgtgatgttatgtctgatgttgtgtttttagagctgtgaaaagtctgaaaaatttcaaggggtattatttaaatgatgattatctggctgaattatgtgtgagctagaatctagggtagctgtccacttctttttctgttgtcctgacagtaaagcaaatagtaagccatgtcttgaaagtgatttgcttgtttcatactgacatctaaagacatcagccttctctttggcaaccctggggatactcctctgcaccataacttattaatgtttttttagacaaggctaaacctgaatgactctacgtatctatagtttcactgctcatataccagctgctacaagaaaaaccatgacttgtaagtttgtctttactcctaattgctaaattaactgaaacccttcctgtctagggagaattgctgctagtaaggtcagtttgcaatgttcagctttagatatgtgtcgtaatgggagtctgaaaactgtaataaactgtattcatatcctg

SEQ ID NO: 52765 - DNA, 2862 bp, Homo sapiens
tatgcctgtttttatgtttacctataattttcatatagccgtataaggattgatttaccattttttgcccaacatgacaattctggctatgaaaattatgtttaaactgtgtatgatctattttatgtgctctatgttcccatttgtttgtttggtctggacagtggttctggaatgaattctatctagtaaattagtaaatgtgctgttttgtataaagcatgataattactttttaacagaagttcatttttaaagattactcccttttctttctctctttttttttgagacaatttctctcttgttgcctaggcagtgcagtggcgcgatctcagctccctgcaacttctgcctcccaggttcaagcgattctcctgccttagcctcctgagtagctgggtcagccaccatggctgactcattttttgtatttttagtagagaaggggttttaccgtgttggccgggctggtcttgaactcctgaccttgggtgatccacctgcctcagcctcccaaagtgctgggattacaggcgtgagctatcccgcccggtccccttttctttattatcgaagatattgtttaaaagaaagaaaaagtaggtcccaataatatatgtgctattcaaaaaatgtgatcatttaggacattatcacaagttgctatggaaataactgaagacttcctcaggagaaggaaagaaaatgaggaacataatgatagagtcggggaactcccactagctcacctgaggggggctcgatgcagctgaaatactgaatactgaaatactagaaaccaacaaaactggtttctagaattctccagggatttgggcttgggaaacttggtaagaatagtttttatttttgaacattcaactttggttcttcaaagtaatctttaaacatgggaatatgttttcaagacaatttataggacatacttatgtagttggtgaggtcttctcaaaagtatctacctttgttagataataacaagtgattaagaaaggggagatatggttttatactcataacaatttcctgtgccattctctgtacacagaggtgattcatttactctcccattagtagaacttgcactttgggctgtctgttctagtatttgggaagtgtttatgcttccttccagggaccatcttatgatcagaggcaggatgtctgtgagatggttagctagagttagcagtgtccggggagagtggctttagaccagtcagtaccttgctctttgtgcatggtgcatgtcaagtcaggaagccaagaaaccgttggcattaaaatctagatgcatagagatccttgctatgagttgtggataggagtggctccatctatccttgtggtgaaagagtccaggagctcctttagagattgtcaagtcctgagcgatgagctgcccttaatcctcagaagccttacaaaaattgagatgtaccatttctaccctttgagaaaaaagaaatagaaacttacttgatgcagaatggatatttatatttctgcttgcaccatttccatagcagctgacaaaggcaaaatcatgaaatagaatcatttctataaattgcttctttaagttttctctaaattttgcctctaggaaaaaattaaaactattcaatgacagctagctgtcactggtgctaccccaaagctttccaatcttttatgtattttttgtgaatgaaactgttgctgtaggaaagtcaaggttcatgtaagagtatcgtggtgtaaatataatggtttcacagctgtttgaatttttcttttcctgtgccagatatagaatgcagtcaaccctttttcagtaacttatgttcaccagtctgtgcttttcttctcccagaaggcttttcttagtggttgtaaatgcaagaatcctgagccctgtgttgcaaaggtgggtggtctgtcagcactttctggcaaattgagttgatggatttaagataagcctttggggttcctgtcagttttctgggccctgaggaagggttgggcctcctttactctcagtattttgagtgtttttcaaatgtttgtacgttatcttgcactgctctaataaaaatgaaagctctctgacaagaaatagttctggatggtttgaagatctgcggggaaaaataagtgtgcacctgagaccttcagttagtcttttatttatttagaataaaaaatagtttgataacctaccagagttagtgcttctttaaaaacactccttggaaagatggggactgtcccttaggaaagccataaaagtgattcccaatactttgcaattgcttttgatttttagtcctttggaacaaatgtgtgatgttatgtctgatgttgtgtttttagagctgtgaaaagtctgaaaaatttcaaggggtattatttaaatgatgattatctggctgaattatgtgtgagctagaatctagggtagctgtccacttctttttctgttgtcctgacagtaaagcaaatagtaagccatgtcttgaaagtgatttgcttgtttcatactgacatctaaagacatcagccttctctttggcaaccctggggatactcctctgcaccataacttattaatgtttttttagacaaggctaaacctgaatgactctacgtatctatagtttcactgctcatataccagctgctacaagaaaaaccatgacttgtaagtttgtctttactcctaattgctaaattaactgaaacccttcctgtctagggagaattgctgctagtaaggtcagtttgcaatgttcagctttagatatgtgtcgtaatgggagtctgaaaactgtaataaactgtattcatatcctg

SEQ ID NO: 52766 - DNA, 391 bp, Homo sapiens
caggaatgctggaatgattttgctgtagggaaagttatttaaaatgttgcccccaaataaatatgaggatagaccctgagcctgcctggagagagggcatttgtgttgctgtagttacttcaggcctcattccagctttgcatgacaccgtccatggaggagcttgtgatagggagggggctgcagaaatgaggttttatttcttcccctcttgatgtgataaacccgtgtaggcatctttggaatgtaaccataccaaagatcctgttgcctttacaactccatagggttctgggccatttccaagacattatctggagagagaaaaatgttcagggtgctgaaaaaaaaagcgccttaattatgtttagagccattttcagcatgactg

SEQ ID NO: 52767 - DNA, 365 bp, Homo sapiens
agattaattgcctactaggtggttaacctgggataattattgattactcttctgtcacttcaagtacaaaatgtctaaaatggaactactcatcagaacacttcctgtaatctcagcactttgggaggccaaggtgggtggatcacttgaggtcaggagctcaagaccagcctggccaacatggtgaaaccccatctctactaaaaatacaaaaaactagccggttgaggtggcaggcacctgtaatcccagctactcgggaggctaaggcgggagaattgcttgaacccgggaggtggaggttgcagtgagccgagattgtgtcactgcactacagcctgggcaacagagggagactccatctc

SEQ ID NO: 52768 - DNA, 297 bp, Homo sapiens
cttagattacctagcaaaagaaacgcaattcccaagacatatccatgtcaaatactatttcctccctaaaggaggctgtctactttctaggtatgttctttcttaccaaaagagaagatacaagcaaagaaacttgcataatctaaatccaggctggatcatttcagattttataatgcatactaccctatagaagccttaattaaacattttatagagccttaaactctcaaatagctgtgctgctatggcacaaggaggtccatgcagaaaaatcagttaaaaacaagtggttgt

SEQ ID NO: 52769 - DNA, 453 bp, Homo sapiens
tgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaa

SEQ ID NO: 52770 - DNA, 2381 bp, Homo sapiens
catgttatgtattcttttgaaaagtatctgttcatgtcctttgcccacttttgatggggttgtttgttttttttcttgtaaatttaagttcctggcagatgctggatattagacctttgtcagatggctaggttgcaaatattttctccctttctgtgagctgttcactctgttgatagtttcttttgccgtaaagaagctctttagtttaattaggtcccatttgccaatttttgtttttcttgcaattacttttggcatctttgtcatgaagactttgagtctgattacaaaaagtactgtgtgttacagcaaagctaccactctggctgctagacagcttggtggggagggagatgactccttgtagctgatacttggcaaagatgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaggtttggcaccagccacctgggaccaaataagaattcaattgtgcttgtccagatatgaacaaatatgtagtgagtatagagtttatcaataatcataacaaatattaaagatttccttggagtcaaagtaaagaacaaaaaattataatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgcctttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttgttcttttccgtgtttattttgcactttaaaaaagagagaacgcatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaattattcaagactggcacaaaagtataaatattatttatttcaggtagaatttttttcgtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatgtctagttctcagagcatttggaaaggttatcttaaatggctacctaaattgaaatccttttcagaaaaaatataattgcaaataggtaggagtggcctaaattatctaatgtaataaagtcagacaaaatgcatactttatagtttcaagattttcagtacataaaatctgtcctttcctacctggacatgtcccattaaaaagtgggagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactattatccaaacaaattaaatactgtggatgcctctatgtactgtttttcctcatacaagtaaacacagaatgtcaaatt

SEQ ID NO: 52771 - DNA, 3788 bp, Homo sapiens
cttagctggaagggatctgttccagcgctgagcttttattttgcttagcatctactcagatgccttgactgtgtgtgtctcacagtcctactgactgacaaactccctgggggccgagatggcatggattcaggtctcagatgctctatggcacctgggagcatcttacacaggtgaagtgctcagtgatgatctggggtcactattctctgcagatcagcatgtctgagaggtaggggctcacagactgtggaactggtgtaagacctttgtcttttcccagctactaacaggtcctgcttgtcacagcccttccatgatacaaagttaagtcattttgtgtctgacacaggcaaaggaaaacgacaggcccttgccttcccggtcctcaagggtcagctgtaagatgatgtcataaagccggatcaggtcctggggccggggggaagcacttgctgtcatcctctggctgctgctgcagcagagccctctgcagacctttggccatgctctcattacacttgattgccattgacagcttgatgtaagtcaggttgtagatgagcatgagagtgtggagcagagtcggcgagcgcaagtcgagcccatcaacctggacagctgtctccgtgctttcaccggtgaggaagagctaggggaagatgagatgtactactgttccaagtgtaagacccactgcttagcaacaaagaagctggatctctggaggcttccacccttcctgattattcaccttaagtgatttcagtttgtaaatgatcagtggataaaatcacagaaaattgtcaaatttcctcgggaaagttttgacctgagtgcttttttggtaccacgagacccggctctctgccagcatcaaccactcacaccccagggggatgagctctccaagcccaggattctggcaagagaggtgaagaaagtggatgtgcagagtttggctggggaataggacatgctcctgagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctctggctgccccagattggcagcaaaaataaactgtcaagtagtaagaagaacttggatgccagcaaagagaatggggctgggcagatctgtgagctggctgacgccttgagccgagggcatatgcggggggtgggcagccaaccagagctggtcactcctcaggaccatgaggtagctttggccaatggattcctttatgagcatgaagcatatggcaatggctatagcaatggtcagcttggaaaccacagtgaagaagacagcactgatgaccaaagagaagacactcatattaagcctatttatatgcaatttcatgccattcaggaattctgagtgggggccattacgtcacttatgccaaaaacccaaactgcaagtggtactgctacaatggcagcatctgtgaggaacgtcaccctgatgaaattgacaccaactctgcctacattcttttctatgagcagcagaggatagactacgcacaatttctgccaaagattgatggcaaaaagatggcagacacaagcagtatggatgaagactttgagtctgattacaaaaagtactgtgtgttacagcaaagctaccactctggctgctagacagcttggtggggagggagatgactccttgtagctgatacttggcaaagatgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaggtttggcaccagccacctgggaccaaataagaattcaattgtgcttgtccagatatgaacaaatatgtagtgagtatagagtttatcaataatcataacaaatattaaagatttccttggagtcaaagtaaagaacaaaaaattataatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgcctttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttgttcttttccgtgtttattttgcactttaaaaaagagagaacgcatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaattattcaagactggcacaaaagtataaatattatttatttcaggtagaatttttttcgtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatgtctagttctcagagcatttggaaaggttatcttaaatggctacctaaattgaaatccttttcagaaaaaatataattgcaaataggtaggagtggcctaaattatctaatgtaataaagtcagacaaaatgcatactttatagtttcaagattttcagtacataaaatctgtcctttcctacctggacatgtcccattaaaaagtgggagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactattatccaaacaaattaaatactgtggatgcctctatgtactgtttttcctcatacaagtaaacacagaatgtcaaatt

SEQ ID NO: 52772 - DNA, 791 bp, Homo sapiens
ctcacccgccttcagagacttcttggcccatcttagctggaagggatctgttccagcgctgagcttttattttgcttagcatctactcagatgccttgactgtgtgtgtctcacagtcctactgactgacaaactccctgggggccgagatggcatggattcaggtctcagatgctctatggcacctgggagcatcttacacaggtgaagtgctcagtgatgatctggggtcactattctctgcagatcagcatgtctgagaggtaggggctcacagactgtggaactggtgtaagacctttgtcttttcccagctactaacaggtcctgcttgtcacagcccttccatgatacaaagttaagtcattttgtgtctgacacaggcaaaggaaaacgacaggcccttgccttcccggtcctcaagggtcagctgtaagatgatgtcataaagccggatcaggtcctggggccggggggaagcacttgctgtcatcctctggctgctgctgcagcagagccctctgcagacctttggccatgctctcattacacttgattgccattgacagcttgatgtaagtcaggtaggtggaatgcaccacacatcagctcaagttgtactcagagaagcagaggaactgggaggactggactacgagttggggctgacccagaggaagtgggggggtgagttggggcaaggccacagcagggccatttggcctgggcttcaagggaccctgtaatcccaactacttggcaggctgaggcaggagaatcacttgaatccg

SEQ ID NO: 52773 - DNA, 3700 bp, Homo sapiens
aacgtgctgggctgaccttcctctgatcacaggcaaggcaaaggaaaacgacaggcccttgccttcccggtcctcaagggtcagctgtaagatgatgtcataaagccggatcaggtcctggggccggggggaagcacttgctgtcatcctctggctgctgctgcagcagagccctctgcagacctttggccatgctctcattacacttgattgccattgacagcttgatgtaagtcaggtgaacaaatagaagctgagggtgaaggacctacagctgtcacctttatctcttctcaacactgccaactgtccccttggatctcccagacagacaacaagggacatctctggtttctcggtgccccctagaaacctcgggtcatttcaaggcattatgcaaatgagaagctttccttctcttcacctcatctcctgatctgcacaaaagtgactgtaggacccagtgttgtagatgagcatgagagtgtggagcagagtcggcgagcgcaagtcgagcccatcaacctggacagctgtctccgtgctttcaccggtgaggaagagctaggggaagatgagatgtactactgttccaagtgtaagacccactgcttagcaacaaagaagctggatctctggaggcttccacccttcctgattattcaccttaagtgatttcagtttgtaaatgatcagtggataaaatcacagaaaattgtcaaatttcctcgggaaagttttgacctgagtgcttttttggtaccacgagacccggctctctgccagcatcaaccactcacaccccagggggatgagctctccaagcccaggattctggcaagagaggtgaagaaagtggatgtgcagagtttggctggggaataggacatgctcctgagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctctggctgccccagattggcagcaaaaataaactgtcaagtagtaagaagaacttggatgccagcaaagagaatggggctgggcagatctgtgagctggctgacgccttgagccgagggcatatgcggggggtgggcagccaaccagagctggtcactcctcaggaccatgaggtagctttggccaatggattcctttatgagcatgaagcatatggcaatggctatagcaatggtcagcttggaaaccacagtgaagaagacagcactgatgaccaaagagaagacactcatattaagcctatttatatgcaatttcatgccattcaggaattctgagtgggggccattacgtcacttatgccaaaaacccaaactgcaagtggtactgctacaatggcagcatctgtgaggaacgtcaccctgatgaaattgacaccaactctgcctacattcttttctatgagcagcagaggatagactacgcacaatttctgccaaagattgatggcaaaaagatggcagacacaagcagtatggatgaagactttgagtctgattacaaaaagtactgtgtgttacagcaaagctaccactctggctgctagacagcttggtggggagggagatgactccttgtagctgatacttggcaaagatgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaggtttggcaccagccacctgggaccaaataagaattcaattgtgcttgtccagatatgaacaaatatgtagtgagtatagagtttatcaataatcataacaaatattaaagatttccttggagtcaaagtaaagaacaaaaaattataatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgcctttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttgttcttttccgtgtttattttgcactttaaaaaagagagaacgcatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaattattcaagactggcacaaaagtataaatattatttatttcaggtagaatttttttcgtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatgtctagttctcagagcatttggaaaggttatcttaaatggctacctaaattgaaatccttttcagaaaaaatataattgcaaataggtaggagtggcctaaattatctaatgtaataaagtcagacaaaatgcatactttatagtttcaagattttcagtacataaaatctgtcctttcctacctggacatgtcccattaaaaagtgggagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactattatccaaacaaattaaatactgtggatgcctctatgtactgtttttcctcatacaagtaaacacagaatgtcaaatt

SEQ ID NO: 52774 - DNA, 3667 bp, Homo sapiens
atgtgaccagaggactattaaactcttttagcatcagtgtagcaaggaggtaaaaaaacaaacaacaaaacaaacaaaaaaaaccctttttgtaaaataggtttgagtatcgttggattgagcacttaccaagcaactgtgccaggcatttgtgtccttcatttaattcttacaagcctgagtgttcggtattttaattttataggtgaacaaatagaagctgagggtgaaggacctacagctgtcacctttatctcttctcaacactgccaactgtccccttggatctcccagacagacaacaagggacatctctggtttctcggtgccccctagaaacctcgggtcatttcaaggcattatgcaaatgagaagctttccttctcttcacctcatctcctgatctgcacaaaagtgactgtaggacccagtgttgtagatgagcatgagagtgtggagcagagtcggcgagcgcaagtcgagcccatcaacctggacagctgtctccgtgctttcaccggtgaggaagagctaggggaagatgagatgtactactgttccaagtgtaagacccactgcttagcaacaaagaagctggatctctggaggcttccacccttcctgattattcaccttaagtgatttcagtttgtaaatgatcagtggataaaatcacagaaaattgtcaaatttcctcgggaaagttttgacctgagtgcttttttggtaccacgagacccggctctctgccagcatcaaccactcacaccccagggggatgagctctccaagcccaggattctggcaagagaggtgaagaaagtggatgtgcagagtttggctggggaataggacatgctcctgagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctctggctgccccagattggcagcaaaaataaactgtcaagtagtaagaagaacttggatgccagcaaagagaatggggctgggcagatctgtgagctggctgacgccttgagccgagggcatatgcggggggtgggcagccaaccagagctggtcactcctcaggaccatgaggtagctttggccaatggattcctttatgagcatgaagcatatggcaatggctatagcaatggtcagcttggaaaccacagtgaagaagacagcactgatgaccaaagagaagacactcatattaagcctatttatatgcaatttcatgccattcaggaattctgagtgggggccattacgtcacttatgccaaaaacccaaactgcaagtggtactgctacaatggcagcatctgtgaggaacgtcaccctgatgaaattgacaccaactctgcctacattcttttctatgagcagcagaggatagactacgcacaatttctgccaaagattgatggcaaaaagatggcagacacaagcagtatggatgaagactttgagtctgattacaaaaagtactgtgtgttacagcaaagctaccactctggctgctagacagcttggtggggagggagatgactccttgtagctgatacttggcaaagatgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaggtttggcaccagccacctgggaccaaataagaattcaattgtgcttgtccagatatgaacaaatatgtagtgagtatagagtttatcaataatcataacaaatattaaagatttccttggagtcaaagtaaagaacaaaaaattataatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgcctttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttgttcttttccgtgtttattttgcactttaaaaaagagagaacgcatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaattattcaagactggcacaaaagtataaatattatttatttcaggtagaatttttttcgtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatgtctagttctcagagcatttggaaaggttatcttaaatggctacctaaattgaaatccttttcagaaaaaatataattgcaaataggtaggagtggcctaaattatctaatgtaataaagtcagacaaaatgcatactttatagtttcaagattttcagtacataaaatctgtcctttcctacctggacatgtcccattaaaaagtgggagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactattatccaaacaaattaaatactgtggatgcctctatgtactgtttttcctcatacaagtaaacacagaatgtcaaatt

SEQ ID NO: 52775 - DNA, 2683 bp, Homo sapiens
agccgccacccggcgcccggcaggggggagcctggctgcgggcggggaccggggggcgggccgcgccgcgcggagaaaagcgctggccggagggcccgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaa

SEQ ID NO: 52776 - DNA, 2573 bp, Homo sapiens
gcccgggtgccaatgcgaggtggagcatggccgggttgtctgggccccactcacggccagcagcagcagcaggggccacggcatggtgggggctggaagccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaa

SEQ ID NO: 52777 - DNA, 2762 bp, Homo sapiens
agccgccacccggcgcccggcaggggggagcctggctgcgggcggggaccggggggcgggccgcgccgcgcggagaaaagcgctggccggagggcccgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaatgaagactaaggaaacagcccagggttcggaagctgagatgctaccctgggggtagagcatagacatgggtcgggcaga

SEQ ID NO: 52778 - DNA, 1387 bp, Homo sapiens
cgagctcggtaccctcataggcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaa

SEQ ID NO: 52779 - DNA, 2701 bp, Homo sapiens
agccgccacccggcgcccggcaggggggagcctggctgcgggcggggaccggggggcgggccgcgccgcgcggagaaaagcgctggccggagggcccgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttctttgctttactca

SEQ ID NO: 52780 - DNA, 2629 bp, Homo sapiens
agccgccacccggcgcccggcaggggggagcctggctgcgggcggggaccggggggcgggccgcgccgcgcggagaaaagcgctggccggagggcccgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggagcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaa

SEQ ID NO: 52781 - DNA, 282 bp, Homo sapiens
ctcattaccctagcttgccccatatgattgcaataaaaatcaacaaggaaatgcatatgaaactatatttaagctgccaaatattagacacatatttatctatttattgagatgaagttttgctcttgttgcccaggttggagtgcaatggtgcgatctcggctcactgcaacctttgcctcccagctcaagcgattctcctgcctcagcctcccgagtagctgggactacaggtgccagtcaccatgcccagctaattttttgtatttttgtagagatggg

SEQ ID NO: 52782 - DNA, 762 bp, Homo sapiens
gtaatgaagttaatcagtaaaccacacaacctctgtcctctctcactccttacctagtctcattttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtaggacactgttcacaggtgctttcaggtcgagctcttgcaactggactgaggaaatctggggactttggttggagatgacagtaacagatgtctgtcaaagatagtggctcagtcagacccagaagactggaatgagagtttgggttggggtgatttttatagggttctaaacagacgaatatcttatggggatgaaatccaaggatgtttcccctaatattcttcatagactcttatgtcaaattatcactattcttccaaaccaaacattagacaattctaatattaatatcaatggacacttgaaaaaacattttaacagacattatttaatgcagtgctcctaaaatggcaagtctcagttcccaggggatcacaaaatttatttagtgtctcgtgaccagcattaaaaactggattagaatataatagaatagaaatattagtgtccctcaaggagtaaagacaagtggtatttcatgaaattttgtttcagttacatgtgtataagtatgtacgagggatatgagataaaatgtatctaaaaccgtaggttgtggt

SEQ ID NO: 52783 - DNA, 448 bp, Homo sapiens
gtaatgaagttaatcagtaaaccacacaacctctgtcctctctcactccttacctagtctcattttcagtggctgtgaataagctaagaatggtaatgcagtttcaggggttagaaaatccaattcaaattagtcctcactgcagctgtacgccgtcaggatttttcatggaaatgatgagtatgaagcccgcgaaagggcttctcagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaatttaccttttcagaaagcatactctaaattaaagtcgaactacctctactccctccac

SEQ ID NO: 52784 - DNA, 2753 bp, Homo sapiens
gctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaaaacaggcattttctttgggaacaaaatttgataaatatacaaactcatttctttaaatgttgaaagacatcctattgaatctgagggggtaatttacagaaagatactgtctctcgcacttttgtcatctctggaaaagtcctggtgaatagtcattcatttgtaatagccctctgatcatttccttttctttgaagttcaaagagaatagcaaacagaaaagttaacaattttcacataaaatattccctcaagcaatcctttcccccatagttagtcttgaggcaggattcacaaattcagagtatgcagctaactgcagtgatgggaccttcgctttcctctcttaaaagtgaggaaatgattggcttcattgtatccaatcatctttctgttttgttttgcttttgaaaacattcctacagctgggagcacagctgctgtatacttcccccaaagcaggaattagttcatttccttccttcattgttacactgttgcattcttctccctattatcctttggtgaatacaataaaacaccttctataagtaatgggc

SEQ ID NO: 52785 - DNA, 2098 bp, Homo sapiens
gctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttgctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaa

SEQ ID NO: 52786 - DNA, 1918 bp, Homo sapiens
gtaatgaagttaatcagtaaaccacacaacctctgtcctctctcactccttacctagtctcattttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaa

SEQ ID NO: 52787 - DNA, 895 bp, Homo sapiens
gctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttgatttcctgggttggttccaatctctgccatctactaccctgtggtcttggacaaattccttaactttgcacaagttacttgccttatttaaataaggtgataagaagaatgcctggcacatcacaagtactctatttgccactaaaattcactctcacaacacacctataagggcttctcagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaatttaccttttcagaaagcatactctaaattaaagtcgaactacctctactccctccac

SEQ ID NO: 52788 - DNA, 2193 bp, Homo sapiens
gctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaa

SEQ ID NO: 52789 - DNA, 2004 bp, Homo sapiens
gctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttgctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaa

SEQ ID NO: 52790 - DNA, 1283 bp, Homo sapiens
gctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttgctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtaagcatctttgattggcagttttctccttcaggttttactatattggttgttgaaatcccttgaactaattgcttcccttttcccaggcaacttcccattttctcctcctgtgcgcctacctcctcctacatcctcacctttgttgtgtagtcaaagatctgtaggaaaagactgttagagtatttagcttaatgtttaagactgttagagtatctagcttagagtgtttagctttcttccttttcacaacctcacacgtagctaaagggaacttatgattaaattgaattttttgtaggttttgtttgtttttgttgtttttttaaaaaagaaagaagaaagtgatgaacacatctcttttaaaattaagatctagaagaatacaactttattcaataaatatttaaaaatatttttcatgtactttagttaattgagaaagagagaaagaaagagccaagtaataatagcttatattacaa

SEQ ID NO: 52791 - DNA, 1861 bp, Homo sapiens
  misc_feature (230)..(230): n is a, c, g, or t
  misc_feature (1631)..(1631): n is a, c, g, or t
cgcgcggggaagggaagaagaggacgaggtggcgcagagaccgcgggagaacacagtgcctccggaggaaatctgctcggtccccggcagccgcgcttcccctttgatgttttggtacgccgtggccatgcgcctcacattagaattactgcactgggcagactaagttggatctcctctcttcagtgaaaccctcaattccatcaaaaactaaagggatgtggagagtncggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttantatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagta

SEQ ID NO: 52792 - DNA, 630 bp, Homo sapiens
  misc_feature (400)..(400): n is a, c, g, or t
tgcctagtaagcacctgtaaagcttcattgttctgattgtctttttgattctcttcccttgcagatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttantatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagta

SEQ ID NO: 52793 - DNA, 1975 bp, Homo sapiens
  misc_feature (230)..(230): n is a, c, g, or t
  misc_feature (1745)..(1745): n is a, c, g, or t
cgcgcggggaagggaagaagaggacgaggtggcgcagagaccgcgggagaacacagtgcctccggaggaaatctgctcggtccccggcagccgcgcttcccctttgatgttttggtacgccgtggccatgcgcctcacattagaattactgcactgggcagactaagttggatctcctctcttcagtgaaaccctcaattccatcaaaaactaaagggatgtggagagtncggaaaaggggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtcctataatgtaatacctttaaacttgactctggacaacagagtggcagaccagctctgggtgcctgatacctatttcctgaacgataagaagtcatttgtgcacggagtgactgttaagaaccgcatgattcgcctgcatcctgatggcaccgtcctttatggactcagaatcacaaccacagctgcctgcatgatggacctaaggaggtacccactggatgaacaaaactgcaccttggaaattgagagctatggatacacaactgatgacattgagttttactggcgtggcgatgataatgcagtaacaggagtaacgaaaattgaacttccacagttctctattgtagattacaaacttatcaccaagaaggttgttttttccacaggttcctatcccaggttatccctcagctttaagcttaagagaaacattggctactttatcctgcaaacatacatgccttccatcctgattaccatcctctcctgggtctccttctggattaattacgatgcttcagctgcaagggtggcattaggaatcacaactgtcctcacaatgaccacaatcaacacccacctccgggaaactctccctaaaatcccctatgtgaaggccattgacatgtacctgatggggtgctttgtcttcgttttcatggcccttctggaatatgccctagtcaactacatcttctttgggagggggccccaacgccaaaagaaagcagctgagaaggctgccagtgccaacaatgagaagatgcgcctggatgtcaacaagattttttataaagatattaaacaaaatgggacccaatatcgatccttgtgggaccctactggaaacctctccccaactagacggactaccaattacgatttctctctgtatacgatggacccccatgagaacatcttactgagcactctcgagataaaaaatgaaatggccacatctgaggctgtgatgggacttggagaccccagaagcacaatgctagcctatgatgcctccagcatccagtatcggaaagctgggttgcccaggcatagttttggccgaaatgctctggaacgacatgtggcgcaaaagaaaagtcgcctgaggagacgcgcctcccaactgaaaatcaccatccctgacttgactgatgtgaatgccatagatcggtggtcccgcatattcttcccagtggttttttccttcttcaacatcgtctattggctttantatgtgaactaaaacatggcctcccactggaagcaaggactagattcctcctcaaaccagttgtacagcctgatgtaggacttggaaaacacatcaatccaggacaaaagtgacgctaaaataccttagttgctggcctatcctgtggtccatttcataccatttgggttgcttctgctaagtaatgaatacactaaggtccttgtggttttccagttaaaacgcaagta

SEQ ID NO: 52794 - DNA, 787 bp, Homo sapiens
cctcagaattctaccagtgcacctcattcagacattcatcaagaaaaaggccagctgaaggcagacagccaacaaaactcagtcgttagccacagccctggctgtcctcgtccatcaagcctgcccattgtgagcttccattcatcttacctgtctgttatggaagagtgaagtggaaaaggcatggaggactcagaagacctgctaccgagaagagccccattgcaatcagaagattatttatggaaaaaagcaaaatggagatatttaaaagactgagagagacagcagaaagctgcttaagaaattgctttgagtccacaggagggaagcacaaaggagatgggataatagtgttatacactacatgatatcacagagctggcagagttaatgagtatcttggacaattgcaccaaatgcaatggattgggatcactaaatcaagacgtaatttgatagaaataaaggtaaggccactttattccagataccaactgcaaaagagacaagataatagagaaagtttgggctttagcagcactaatgattgaaaaagtcacagggctttagttagtatcagtcaactttatgaatcagctacccagaaaggctaatatgattttaggatgcactactataaatgaagtaactagaatgacaagaaaattgacctttattttatgccaatcattccacatcaaatgtgcctcaggttaggtgccaaactctaggaggctattcataaattaacctatattcggagaaaccaacaagtctgaaaaag

SEQ ID NO: 52795 - DNA, 366 bp, Homo sapiens
tcatctctgtacccttatgtctatcatgttgtaggttctgcataaatggattttgaagtgattaaaaccaccattattcctggctcaatcagctggttgaagaagcagctctcctatttcacctttcctctctcttccagccccattgcaatcagaagattatttatggaaaaaagcaaaatggagatatttaaaagactgagagagacagcagaaagctgcttaagaaattgctttgagtccacaggagggaagcacaaaggagatgggataatagtgttatacactacatggtaagtgtaataaactccaagctgggaggacagcaagggcactctgtgtgggttaattggtgccctgcctacg

SEQ ID NO: 52796 - DNA, 979 bp, Homo sapiens
cctcagaattctaccagtgcacctcattcagacattcatcaagaaaaaggccagctgaaggcagacagccaacaaaactcagtcgttagccacagccctggctgtcctcgtccatcaagcctgcccattgtgagcttccattcatcttacctgtctgttatggaagagtgaagtggaaaaggcatggaggactcagaagacctgctaccgagaagagccccattgcaatcagaagattatttatggaaaaaagcaaaatggagatatttaaaagactgagagagacagcagaaagctgcttaagaaattgctttgagtccacaggagggaagcacaaaggagatgggataatagtgttatacactacatgatatcacagagctggcagagttaatgagtatcttggacaattgcaccaaatgcaatggattgggatcactaaatcaagacgtaatttgatagaaataaagtgacctcttcctgatgtatctccaaggctcccttgctaccaacttcgcactaggtttggctgatggagataagaagaaagaatatatggatagtacatcttctaagcatttgtatctcttgaagtatgaagttcttgcctccatttctgacaggcaatttggctggaattatttgaaataatccctgtttgattatctgctggcattttagtgggagagatggggtctctctcttccccaggccggagtgctagagtgcactggcatgattacagctcactgcagcctcgacctcctgggctcaattgatcctctagcctcagcctctggtcctaggaaaactaacacagcaggcttatgctgatggagcagatgcaagcctgtgagccagcacggatttcccaggaacgttgctgttcgctaggccacgtgctggcctcacagctggtgatgagaaggcgaagacagagtcagcttaaccaaggcactgtgggctctgtgaaagcctt

SEQ ID NO: 52797 - DNA, 459 bp, Homo sapiens
ctggctattttaagtactcacttattcctgtgggacttgaaccaaggtcatttgctttggccagcttagtagcccagagacttgctttcagaatggatgttcttgtattggattactgagtctgatccctcttttatttttctcctccaaaagtacaaaacaaagaggagctcatgatacaattgatactgagaatcatggcatagatttgtatccgtgactgctgccttaaaaaaccatcccaaaacagtggctttaagcaacagctacttctatacttcctgtaagtctatggattgcctgggtaattctgctaatacggacaggcttgattcatcttgactggtgtccctcatacattgtgcactggggcctggctcatcttagatgtcctcagctgcaatgactcacctctctcaccctccttagcaggctaactccagaatatttccatagtgg

SEQ ID NO: 52798 - DNA, 475 bp, Homo sapiens
ggacaatagcttgtgtagaaatattctaaaaataaaaagatttagaagaggaaggctctgactgtaaaaaaattttagggatatcttaaccaatttatttttcttcacctattttcctttttatatattcacaaaaatatgtaaaatttatatttaattaaatctaaaagagttctttcaataagcataagacaaaaatcctgaacgataagagagatttgtgttaccacataattattatttttctttgtttcttagggagtgcctaaaacaatggtgccttcgaggtgatgaaataccatccttgtttagggtcttgattttcagcgacagggaagccggctctgcctcattcacagctgtatcccctgcggctgacacagagctgggacagagcagccattcaataaacatctgatgaagtgacttaaggtagcgcctctgccaggcaaagggccacaccaaatggctaaca

SEQ ID NO: 52799 - DNA, 604 bp, Homo sapiens
tgggtgcctagaggacccgaacattgtgtctcagtgatgctgtgcaaagtaacctgtggcctaagtcaagtcagaaaatgcttttgactctatatttctcaaaaatgtaagtcttaaaatttggctatggatgggaaaatattacataattgaaaggataaatataagtatgccaatcagccaaaaacactgcaaatgtttaatgcagatttaagttttccctcaaaaactgttaataaattaatagtgcagcttacaaatgatgaaaagagctgagacgtttaaaaaaactttccaagtgtcaggtcctggtactttacatttattctacctcctaatccttatactaggtcaaagctcattttatgtcttcaagattcagatgtaacactgggaatgagaaaggttaatataagtgatatgtccaggactatacttctagtaattatagctcactgatggagagaacattaaaatctgtttggccttcacttaaaaacaaataatatttgtgttatagaagcaagacctttttagtcacaagttaataattttaaagaaaagattcaacatgtaaatttatctggaaaggccaggggtgagg

SEQ ID NO: 52800 - DNA, 328 bp, Homo sapiens
  misc_feature (311)..(311): n is a, c, g, or t
aacttccagaagtgggcagctgtggtggtgccttctggagaggaacagagatacatgtgccatgtgcagcatgaggggttgcccaagcccctcaccctgagatggaagcagtcttctcagcccaccatccccatcgtggggtatcgttgctggcctggttctccttggagctgtagtcactggagctgtggtttctgctgtgatgtgcaggaagaagaactcagatagagtgagctactctgaagctgcaagtaagtatgaagtgggcagggttctgatgtgtctctcacggcttgtaaagtgtgagacanctgccttctgtgggact

SEQ ID NO: 52801 - DNA, 229 bp, Homo sapiens
ggaaaataaaaagacaaaactaacataaaaatttcaggagcttctttgtaaaatgaatagaaattcttcaataggcctctggggctgagatgtgaggaggaggaggaagaaaatgagagtgggaaggacgcactggaggactgttactatctgaatcctatcgcctacaaaacatcaactgatcaatcaggcacaagaaagtgttctgcttctttctgtcaccttagaa

SEQ ID NO: 52802 - DNA, 1132 bp, Homo sapiens
gttcaagaaataggcaggaggaaacacgatggattgggtgggagtagggaaacagatgagaagaggtatcaggaaagctgcctaggtttctggtctgtgccactgtgtggatgatgagagaatgtgtcagtggtggaggccaaggtctgaaagtggagtggggaagagtgagagagaaaattgtaagtttacctttatgttcagctgaggtcattttgaaacatacaagcagcagtatgaagaattccattgatatatttgtccggagcccagagtgaggtttaaataagaagaaataaactcgctagtaaaaattgcagacacacaaaaggcttgaacaggcacttcacaaaatagattatccaaatgaccaataaatacataagtactcaacatcattagccattagaaaaatgcaagttaaaaccacaatgagataccatttcacactagaatgaataaaatattaaaagactgacaatgctaaatattcccaggatgcagaacaaccaaaaccctcatatattatgggggacatggaaaattgtacaactcctttggaaaacaggtagtttctacagaatttcaatatatacataccatacaactcagccattgcattcctatttaccccacagatataaaatcatttgtctactgaaaaatttgcaaaataatgttcattgcggctgtagccattataaccctcaaacggaaacaacccaatgtgcatggattgtgaatagatgacaaatggtggtccatctatacaatggaatattgctcttcaacagaaacaaactacaggtccatgtaacaacatgatgattgaaagaagtcagatgtaaaaaagtacatatgtatgatgcaatttatacgaaactctaggcaaaactaatccttagtgatgaaatcagatctgaggttgcctggggcagagatgggggtagctgactgcaaggaggtgtggggagggttgtgaattttggggagtgatggagctgctctgtatctcaattgtgatgtggttacacaactgtatgcatttgtcaaaactcacagaactacactctaaaacatataaattttactgcatgtaaatcttaccttaattaaaaattaaaaaaattga

SEQ ID NO: 52803 - DNA, 278 bp, Homo sapiens
atgcaatcccactacatagctgtgggactttcggcaagtttcttagatcttttcagtcactgtttcatcatctttaaaacgaaaatgataccaaccaactttaaggctactatgaggaataaaagagattgcatacttaatgattcagcacagtacttggcacattgctctcatttttagatcattcataccacatccaacttccctgcacccattcctcagcttctaactcaccccctcaccataatttgaagtactactgagaagttaacacccga

SEQ ID NO: 52804 - DNA, 599 bp, Homo sapiens
agaagatgtaagaacttaaagtttagattacttacaagacaaagagacatatgcatctcaatagtccctaataggctttaaatataataaactgatgctgctgttgatggtcctgagttatgactgaaatgttaatattcattcaatctattccatttgactggctaggaactaataattttaggtagacttctaatgaaatggataaaatagaataaaatttgatgcctcaaataacagctaacatttactgggggcttatcatgtattaggaactattctgaaagttcaacacatgcttagaggaggttagcttcaattatctgaaaaaattcaattataagaaacatttcaatccgcaaaggcactgggtaaggcatcattgtgttattacagttttctgcatccagtcaaggcttgtacttacctatagggacaaagggggagtctctagatttcctgattagtcgggataattggccttcatcctcatctgctgaccactggttatctgaagacatttttttctctagtaacaataggatataaatgtggttgccgtgaatcattaaaaataatttgtttttcctctcccatca

SEQ ID NO: 52805 - DNA, 261 bp, Homo sapiens
gtccttttatcagggcttctgagatgttcattaagattgtcaattgaatttggcaacacggtggttattggttttggtcattggtcttcctgtccatagttctggaagtgggaggtgggaaccggatgtgaggaaatgaaactaatgagtgcaaattagaaaaaaagtgccccatttccatctgccccaaaactaaacttaatcgatgaaaaatggtgtcttgtgtttttttcatttattgattactagtatgtttgaaca

SEQ ID NO: 52806 - DNA, 340 bp, Homo sapiens
tataaaacgaagcacataatagcaactaacttaaagggtgattctgatgttaaatgaggtagtgcatggtgagaaaccccattcagtgcatggtaagcactcaatgagtgttggctattactgaccttgaggagttcagaaatctttcccttgtaaaggagcttaatccattgcgtccttactgctcatccatttacgttcctggtcagtgatgtgttgaaggaatgattttttaatagaggcttcaaattttctttgcttataactgcagaaagtttagaaaaacaatgaattacctctgtgaaaatacaccttatttctgcatgccaccaagacctgc

SEQ ID NO: 52807 - DNA, 851 bp, Homo sapiens
catcctggagaagatatactgtgttcactattgaaatgaaaccataaagctagagttaggaagattgaagaaatgaaaaaggagctcacatgattttgtctcaggagaggctcttccaggattctttggagatatggtagattccatagctggagcagggaaaggacaggatgagcctgtgggtgtagaaaggaagggagtgcttgaaagatgatgaggagatgtcagcaggtcacagaaaccctctgaaggaggctccaactggccaggctggggacaatttgggccccaaaataatgacagtaacaaattgtaactcattgaatgaaataggaatccatacattggtaattatataaataagggaataaaaccatgatgcaaaaagggatgtttatgtcatcacgcaaaatatgttcacagaaaatatgtactaattaaaagagggaaaagagtaactttacagtggatgaagcctggcaatcatcactttaagcaagtggtcagagttaatattatcagtaatggtcaaatcaaaaccatatgcaagaagactctaaaatgcaagaagactcctgaagtacttcttaccaaagatgtagaacttaaattcagtcataacaatacatgagacaaacccaagttagagcacagtctgcaaaataactggcctgtaatcttcaaatgcatcaagatcatgaaagacaaggaaagagtgaagagctgctccagttggaagagacttaaaactaaatgcaatgtatgatcctagattggatctttttgctctaaggacattaatgggccagttagtgatatttgaaggggatccgagggttccattgtagtaa

SEQ ID NO: 52808 - DNA, 255 bp, Homo sapiens
tggacaggaggtttgctagggagtggtcttgggatcaccacctctggaaggggaaaggaagaaggatggggcaggaagagaagttggctgatgcattagtcagggttcactagagggaaagaactaataggatagatgtatatatgaaggggagtttattaggaagaatcaactcacaagatcacaaggtgaagtcccacaataggctgtctgcaagctaaggagcaaggaagccagtctgagttccaaaacctc

SEQ ID NO: 52809 - DNA, 754 bp, Homo sapiens
aaagcaggagcaggcacttcacatggtgaaagcaggaacaagagagagagagtatgttggggtaggtgcactaccatggagacagcaccaagtcacgaaggattcgacctcatgatccaaacacttcccaccaagctccaccttcagcactggggatctggtttcaacatgagatttgggcgggacatccaaactatatcagctgtctccctcatccaagaccatgtgatccgtagctcacttttgtctagcaacagattaaatacagcattttctgtgtgatatctttgttgaggtctttgcagatggctgtttctttgtcctgaaactttcttcatctgctctttcaaaatgagtgactcttcatcctcgaagtctatgcttatatattgcttttcagaggaatcttttctgaactgggcattctgccttcaaccaactattttctattatagtttcctgtttgtgagttaatagtccttttgaaaatttgactactcatttaccttcttgggttatttgaaattatctcctcttcactagattctatagaagcatagccatgcctgccctctttactgtttctctactgacttgttgcaatgaatattgtcagtaaacatggaaataaatcagttattcagatatcctaccttggtgcttgcttagataactccacactgtgatgcctaatgacctacacagggctttctagcaaggagtgactttctttctgctacgtgtaataatgatc

SEQ ID NO: 52810 - DNA, 234 bp, Homo sapiens
aaaaaaggtattttttctaaaaataggtattgttataaataagcacttacttagctttagtttagttttgttttgtttttgttttttttgagacggagtctctgttgcccaggctggagtgcggtggcgctttctgggctcactgcaacctccgcctcctgggttcaagcatttctgcttcagcctcccaagtagctgggattacaggcgcccgccaccaaattttttattaaa

SEQ ID NO: 52811 - DNA, 319 bp, Homo sapiens
cttttccaggccaagctcctcccgtgtgtgctatcttcaggggtatccataaacatgcttaagaaaccaaaaattacattatttgtcatgagttttaaaaagataattacacctggccgggcatggtggctcacacctgtaatcccagcactttgggaggctgagatgggtggatcacgaggtctggagatcgagaccatcctggctgacgtggtgaaaccccgtctctactaaaaatacaaaaaaattagccgggcgtggtggggggcgcctgtagtcccagttactccggaggctgaggcaggagaatggcgtgaac

SEQ ID NO: 52812 - DNA, 242 bp, Homo sapiens
gagaagttacagctaattgtttacttgagaggtcaaccaatcatttcagcagtgtagttgtaactaagttaaatagctgctaaatagctactggctattcagttagaaagggggtgaggatgacaggctgtgcagaacctgaacagggttaaagctacaatgagaagccataattttgtgagttttgctgagaccaattctccatcctgtcataattagagaacccgatgctgattattttt

SEQ ID NO: 52813 - DNA, 281 bp, Homo sapiens
catgtggcttcctcatcgttatgtgatttccttggggaggggctggctccattccaggcttactgaagagtaacaacactgggcttagccctgtctcaaaaccttaacctgactgggtcacatcccagagatgtcccccgctgccctgaggtcaaagaatgcaaggcctgctttatctctgccagctgcctttcctgtgctggtccccacgaggttttcttgacttttcctctaatttaccagcttactactctgtatcttttgaggaactttgatgccct

SEQ ID NO: 52814 - DNA, 164 bp, Homo sapiens
atcttcacatcatgacgacttggacacttttattgaaatatcaaattctctttttaaaaaaattcccgattcccctctctccctttcgcccacccccctgagcccatgtttagaaggtttagtagaaaaataaatcatggaaacaaagagaatctttacataat

SEQ ID NO: 52815 - DNA, 2691 bp, Homo sapiens
taggcggagcgggctgagcagcccgggcgcgatgcgttgagcgctcggagggccaaccgccggtccccttggcggcaaccggcggcacccatggaaccactgggcaactggaggagcctgcgggcgccactgcctccgatgctgttgctgctgctcctgcaggtggcggggcccgtgggcgccctggcggagaccttgctgaacgcgccgagggccatgggcaccagttccagcccgcctagccctgcgagcgtggtggctcccggaacgacgctgttcgaggagagccggctgcctgtgtttacgctggattacccccacgtgcagatccccttcgagatcaccctttggatcctgctggcctccctggccaagattggcttccatctgtatcacaagttgcccacaatagtgcctgagagctgccttcttataatggttggacttctactaggtgggattatttttggtgttgatgagaagtctccccctgcaatgaagactgatgtatttttcttgtacctcctcccacccatcgtgctggatgccggctatttcatgcccactcgcccattctttgagaacattggcacgattttctggtatgctgtggtagggacactttggaattccattggcattggggtgtctttgtttggtatctgccagatcgaagcattcggcctcagcgacatcactttgctccagaacctgctctttggcagcttaatctcagctgtcgatcctgtggctgtgcttgctgtctttgagaacattcacgtcaatgagcagctctacatcctggtctttggagagtccctgctgaatgatgcagtaacagtggtcctgtacaacttgttcaagtcgttttgccagatgaaaaccattgagaccattgatgtgtttgcaggaatcgccaacttctttgttgtgggaatcggtggggtgctgattggcatcttcttgggctttatagcggcatttactactcgattcacccataatatccgagtgatcgagccactgtttgttttcctgtacagttatttgtcctacatcacagctgaaatgtttcacctctcaggcatcatggcaatcactgcttgtgcaatgactatgaataagtacgtagaagaaaatgtatctcagaaatcctacacgaccatcaagtacttcatgaagatgctgagcagtgtcagcgaaaccttgatcttcatcttcatgggtgtgtctaccgtgggcaagaaccacgagtggaactgggccttcgtctgcttcaccctggccttctgcctcatgtggcgagccctgggtgtttttgtcctgactcaggtcattaataggttccggaccattcccctgacctttaaggaccagttcatcattgcctatggaggacttcgaggtgccatctgttttgcgttagtgtttctccttcctgctgctgtgtttcctcggaaaaaattgtttattacggctgccattgttgtcatattctttactgtcttcattctgggaataactattcgaccactggtggagtttcttgatgtcaagaggtccaataagaaacaacaagctgtcagtgaagaaatctattgtcggttgtttgatcatgtgaagactggaattgaagatgtttgtggacattggggtcacaacttttggagagacaagtttaagaagtttgatgataaatatctgcggaagcttttgattcgggaaaaccaaccaaagtcaagtattgtatctttatataaaaagcttgaaataaaacatgccattgagatggcagagactgggatgataagtactgtccctacatttgcatctctaaatgattgtcgtgaagaaaaaataaggaaggtcacgtccagtgaaactgatgaaattcgagaactcttatcaagaaatctctatcaaatccgtcagcgaactttatcctacaacagacacagtctgacagccgacacaagtgagagacaagccaaggagattctgattcgccggcgacacagtttgcgagaaagcattaggaaggacagcagcttgaatcgagaacacagggcttccacttcaacctcccgatatttatccttacctaaaaatacgaagcttccagaaaagctacaaaagaggaggactatttctattgcagatggcaatagcagcgactcagacgcagatgccgggaccaccgtgctcaatttgcagcccagagccaggcgcttcttgccagaacagttctccaagaaatccccccagtcctataaaatggaatggaagaatgaggtagatgttgattctggccgagatatgcccagcacccccccaacaccccacagcagagaaaagggcacccagacgtcaggcttactacagcagccccttctctctaaagaccagtctggctcagagagggaagacagtttgactgaaggcatcccgcccaagccgccaccacggctggtctggagggcatcggaacctggaagccggaaagcccgatttgggagtgagaagccttaagagaagcagcgaaagcagatctgagtgtctgacccaggacagctgtggtttgtcactctgaaacctgatgcaacagtggaatccatgtaaaactctctgtgcatctaaatacttctggagggcgacagattcatgccacggataaatgaggcaaatccgaag

SEQ ID NO: 52816 - DNA, 2410 bp, Homo sapiens
tgaaacaggacccactggttctatcaaagggaaccaatttcctgtctcccaaattcctccataacccaagttgtgtgtttttattttttccttaccaggcttccatctgtatcacaagttgcccacaatagtgcctgagagctgccttcttataatggttggacttctactaggtgggattatttttggtgttgatgagaagtctccccctgcaatgaagactgatgtatttttcttgtacctcctcccacccatcgtgctggatgccggctatttcatgcccactcgcccattctttgagaacattggcacgattttctggtatgctgtggtagggacactttggaattccattggcattggggtgtctttgtttggtatctgccagatcgaagcattcggcctcagcgacatcactttgctccagaacctgctctttggcagcttaatctcagctgtcgatcctgtggctgtgcttgctgtctttgagaacattcacgtcaatgagcagctctacatcctggtctttggagagtccctgctgaatgatgcagtaacagtggtcctgtacaacttgttcaagtcgttttgccagatgaaaaccattgagaccattgatgtgtttgcaggaatcgccaacttctttgttgtgggaatcggtggggtgctgattggcatcttcttgggctttatagcggcatttactactcgattcacccataatatccgagtgatcgagccactgtttgttttcctgtacagttatttgtcctacatcacagctgaaatgtttcacctctcaggcatcatggcaatcactgcttgtgcaatgactatgaataagtacgtagaagaaaatgtatctcagaaatcctacacgaccatcaagtacttcatgaagatgctgagcagtgtcagcgaaaccttgatcttcatcttcatgggtgtgtctaccgtgggcaagaaccacgagtggaactgggccttcgtctgcttcaccctggccttctgcctcatgtggcgagccctgggtgtttttgtcctgactcaggtcattaataggttccggaccattcccctgacctttaaggaccagttcatcattgcctatggaggacttcgaggtgccatctgttttgcgttagtgtttctccttcctgctgctgtgtttcctcggaaaaaattgtttattacggctgccattgttgtcatattctttactgtcttcattctgggaataactattcgaccactggtggagtttcttgatgtcaagaggtccaataagaaacaacaagctgtcagtgaagaaatctattgtcggttgtttgatcatgtgaagactggaattgaagatgtttgtggacattggggtcacaacttttggagagacaagtttaagaagtttgatgataaatatctgcggaagcttttgattcgggaaaaccaaccaaagtcaagtattgtatctttatataaaaagcttgaaataaaacatgccattgagatggcagagactgggatgataagtactgtccctacatttgcatctctaaatgattgtcgtgaagaaaaaataaggaaggtcacgtccagtgaaactgatgaaattcgagaactcttatcaagaaatctctatcaaatccgtcagcgaactttatcctacaacagacacagtctgacagccgacacaagtgagagacaagccaaggagattctgattcgccggcgacacagtttgcgagaaagcattaggaaggacagcagcttgaatcgagaacacagggcttccacttcaacctcccgatatttatccttacctaaaaatacgaagcttccagaaaagctacaaaagaggaggactatttctattgcagatggcaatagcagcgactcagacgcagatgccgggaccaccgtgctcaatttgcagcccagagccaggcgcttcttgccagaacagttctccaagaaatccccccagtcctataaaatggaatggaagaatgaggtagatgttgattctggccgagatatgcccagcacccccccaacaccccacagcagagaaaagggcacccagacgtcaggcttactacagcagccccttctctctaaagaccagtctggctcagagagggaagacagtttgactgaaggcatcccgcccaagccgccaccacggctggtctggagggcatcggaacctggaagccggaaagcccgatttgggagtgagaagccttaagagaagcagcgaaagcagatctgagtgtctgacccaggacagctgtggtttgtcactctgaaacctgatgcaacagtggaatccatgtaaaactctctgtgcatctaaatacttctggagggcgacagattcatgccacggataaatgaggcaaatccgaag

SEQ ID NO: 52817 - DNA, 278 bp, Homo sapiens
cctgacctcatgatccaccctcctcggcctcccaaagtgctgggattacaggcgtgagccaccgcgcccggccgaaaccttatttattagcagttactgcctgtccccttttttcccccagcccctgccaaccaataatcaatctttatgaacagatttgcctgttctggagacttcacgtgactggaatcatactgtgtgctcttcgtgacaggcttctttcatttagcgtggtatcttaaacattcatccatgttgtagcctgtgtcagtatttca

SEQ ID NO: 52818 - DNA, 1058 bp, Homo sapiens
ccacaccctaccttctaagtcaccaggccatcaagtccagacaaagggatcgaaagagtgagacagtgccagccacctcccacccaagccactagcaagactccacaatgtcagagcaacaaatggacctgaaggatttaatgcccacaaagaggaaatacatgtggaagactgctgaagataggcgcatgtctgacctcacctgtgtgctggagtggctggagcggaggcaggggaagaagaaacaagctcccgagaagcaaaagcccaaagtggtgacagtccttaaacgaaataagaagaaggaagagaagaaaggcaaaggcctcatgacagcacggggagggaaccgcagggacacggagacttcccagcaggccttaggaaagagattcaggaaggacgccgcctcctaccgaagcctctatggagtggagcaaaaggggaaacacctcagcatggtccctggcagctacatcaaggatggccccaagaaatctgatacagacatcaaggatgcagtcgacccagagtccactcagcggccaaacccattccgtcgacaaagcattgtcttagatcccatgttacaggagggtacctttaacagccagagggcaaccttcataagagactggtccaacaagatgcctgacatggcttacgaacgcaagctaaagagcctcatggagaaaagcaccgaacctaagatggaaaccatgaggatgttgaagccagaggaggtgctgagctgccgatacctgaggttatccaaggagaacattcggaccttgctcaagttgtgcaaggatgcaggaatgaatgtggatatccacccccacatggtcgaagaggacatagatgctaaaaaggtgttcaccggaatacccagcatggccctctaaatagctcctctcgccaccaccttcaggctccttctgtcatgggacccttcacctccagatgccatcctctggcacactacaagtggtccttccaacttagtgcatccctttagaaagtaagcaatcagaaaacaagcctcggctgtgtgatca

SEQ ID NO: 52819 - DNA, 236 bp, Homo sapiens
  misc_feature (52)..(52): n is a, c, g, or t
  misc_feature (66)..(66): n is a, c, g, or t
gaaacgagaacttacgaaactctgctgatttttgcctattgtataacttggnatattaaacgtttnaatgaaagcctgcaacaagacaatgcactaatccccccccaaaaggtttgttctgccctcctgcatccactttgtgtttctccttgagcaaagtcgacacatttactcatttaacaaatcctacagggcctcttacagtttcagaactgttttacccatactgtcataat

SEQ ID NO: 52820 - DNA, 1820 bp, Homo sapiens
tgggggtgtccaagagaggggtcttattcgaggaactcacataccccaaataaccatcagtgcacaaatcattccatgctctttggcaccaggcaggagatgctgcaggcaggtgtccgtagttggcaaaaatgggcagtaggggaaatggagttgcttcaacctttctcagtcccggccctcactgcacccaccaagtcaagcagagctgggtgggctgagaccagcatcccagctggactgagcctggggggaggggctggagccaaggagcccccctgggtgggggcatcaggagcaggggcagggcctgaggactgctccccctgcatggagggcaggccaggatggagcccagggtagactttgaggaaggctcagtgggctcagcagaaggaaggctcttctcatagttgtggtttttcacagatggatttgggtgatctgagtgtggtcaggccctgccgttggggaatgaatgccacacggggtttgtctgtaagctgcagtgtctgtgattctgtgtgaactgacagcagggagctgaaggacaggccccggccttgggagaggacacgggcatgggctgctggatgcagggctcccagggctgtgaaggcagaggggtctctggaggcagacagggtgggctgggggccagcagcagggggcagagccccagccagggcagctgcttcctgcacatagacattcctcctgcgcagggccaagtgcccatgagcacagccccagacagacacggtggggagcttggagccctccgctcacctagaggagccctgggacacgcactggaaagtattctaggggcttcctgccttatccttctgtttgttcatacacttagtgaaagcagatcctgtactaggatgtgaggatatctgtcacctgcgtggtccattccataaacaccagattccatttcagttgccacacattttggggctagacttccctaaacaacatgccattgtgaaataatgcatatatttgtatttttaaatttccctgaaaatttaatctattctgttccatatgaagtctgtttcactaccttaaaaaatagatactccactagaggctgtgcttaattcaaatccatgtgtgtgcctgcattacatgtgtgaacacgtgtttctgtcgtgtgtgtcatgcacatctgtgtgttgcatagcataagccaaatgaaaatcatttgttcatgggattcatatgaggaacaaaattaaatttgaatacagtcagataactgccacgcagggcatttggggaaccatccccgaatgccctgatgtgatttccctcagaaaatccttgttattagaggagaaggtctgggcaggggcagcagcatctcagacatcaagtcaactttatcatctactacatcagcactgaagtccagggcattgaggcactaactaggttccattttcttggttggttacttattttttcttttgggttctcggtgtgcagaggctgtagagagagcctcagggcggtgaccgctgcaggaattcggcctccagctcccctccagttaccaggagccgatttggaggccaggccttcccagctgagtgtctgtcagttcattctctctcagctgtgcagtggaagagcaacaacagacaggtgaacttcttgggtgtgcttcacgatggactgcgaaaacacctctctggaatccggaaatcaggccgggcaggggtcaagcctgtaaaccaggaactgggaggggaggggggaccctcgagtcagagcccaaacagcctgtcacatgtgaacccgctcct

SEQ ID NO: 52821 - DNA, 2400 bp, Homo sapiens
ctgagtgggtggacgtggtcgtggatgacctgctgcccatcaaggacgggaagctagtgttcgtgcactctgccgaaggcaacgagttctggagcgccctgcttgagaaggcctatgccaagtgagtagcggctgagggggcaactccagcttccagctccccctaggggtgggggctcatgactgtcttctcagagggtcctgcttgatgccagagtgctgacctggagctgcccacagggtaaatggcagctacgaggccctgtcagggggcagcacctcagagggctttgaggacttcacaggcggggttaccgagtggtacgagttgcgcaaggctcccagtgacctctaccagatcatcctcaaggcgctggggcggggctccctgctgggctgctccatagacatctccagcgttctagacatggaggccatcactttcaagaagttggtgaagggccatgcctactctgtgaccggggccaagcaggtactgccctgggtggggccttccctgaagggcggttcctgccccctggcctgtccttgcctctctggcacctgaccagggctgtggaaggtgctggctcctcctttcccctcctgcagcaccttatctctcttctggggacacccatctgagatgcctatcatgtcctgccctgactgactgtagttcatgtgtgcagctgcctgcctgggctgtgaattccaagaggacaggcttcatctgggtgctgagcagggcttggagaggatgagggtatgggaggcggagtgttaaagtgcgtgcatgggccaggtgcactggctcacacctgtaatcccaacactttgggaggctgaggtgggcagatcacctgaggtcaggctgtctcgaattcccgacctcaggtgatccactggcctcggcctcccaaagtgctgggattacaggcgtgagccaccgcgcctggccaaaacctgtgatttagagagctctggtgactgcgatgctggattagaaggaggagctaaggactagaggttgtagagtaattagtggaagatgatgagggcctgacctaggctggtacagtggtaataaaaaaaagaaatggatgtcactgcacgatagaatagacaggacttggtgaccagcggagtgtgtgggaaggttgagggtgaggagaccggaagagtctctgcagagtctctcgaggatgcacaggtggatggtggtgccttccgctgagataggacatctgggaggatgagcagagccgatttggggtggaaggcaatgattttaggcttgaagtaccgagtcgcgggtgcctggagtatatccagagggcagaaagcaagttacatcaaaggggtaacgaaggtgaatgcttcccgaggccgggtaggtgatgtcaacaggtcagactgaagcagacagatgatcattttacctgtgagtcaggtcaggctcctttctgaaacgcccggatggcttcccattgcacttacgtcaattccgcatttctttccatggcctgcaaggtctgatttgaattggccctgcttttttttcccacctcatttactacacatttttctctctgactgtgttccagccacagtgatcttagtgattttcaagcatatcaaatttgttcctgtgtcagagcccccttctccctggccaagccctcgccaccagatgttctcccactggttcctcatcaggtagctcgtagcttgcctggtatctcaaggaagccttcctgcctataccgccgcatctgaagaggttactgtgtccaccctgtcttgggtttttttccatagcacttgtcactacctgaaatacttatgtgctatctccctccttccattcattccatgaggccacaagtgtgttttgctcatcagtatctctcattgcctagcgtagtgttgggcatgttccacagcatggagagccagtgcttctgggcattgcagtaggtaccagtgagaaaaaaggggaaaatctgcatattgagtatttattaaaaaaaaaaaaaaaaaggagccaaatgaggaagacaggaggaagttaaatgagagaggagaccagctatgatcatgacagggaagtcagtggtaaggtatcgcagagtggttgtcagagggtcatcgatttggccctgcttggggtaattgaagtgtgctagcgaatctaattagtccttgcggtcgttgctgtggggtcagcgagatggaagggtcacagaacactgacttcaaaggagcaaatccagagggcctgtgtgagaggagtctgattgggaggctcgttcctttcactccaaattacttatcctttcaatcccttgacttccacaggaagctcttttgaggccggaagctcttttcaggtgttgc

SEQ ID NO: 52822 - DNA, 2342 bp, Homo sapiens
ctgagtgggtggacgtggtcgtggatgacctgctgcccatcaaggacgggaagctagtgttcgtgcactctgccgaaggcaacgagttctggagcgccctgcttgagaaggcctatgccaagtgagtagcggctgagggggcaactccagcttccagctccccctaggggtgggggctcatgactgtcttctcagagggtcctgcttgatgccagagtgctgacctggagctgcccacagggtaaatggcagctacgaggccctgtcagggggcagcacctcagagggctttgaggacttcacaggcggggttaccgagtggtacgagttgcgcaaggctcccagtgacctctaccagatcatcctcaaggcgctggggcggggctccctgctgggctgctccatagacatctccagcgttctagacatggaggccatcactttcaagaagttggtgaagggccatgcctactctgtgaccggggccaagcaggtactgccctgggtggggccttccctgaagggcggttcctgccccctggcctgtccttgcctctctggcacctgaccagggctgtggaaggtgctggctcctcctttcccctcctgcagcaccttatctctcttctggggacacccatctgagatgcctatcatgtcctgccctgactgactgtagttcatgtgtgcagctgcctgcctgggctgtgaattccaagaggacaggcttcatctgggtgctgagcagggcttggagaggatgagggtatgggaggcggagtgttaaagtgcgtgcatgggccaggtgcactggctcacacctgtaatcccaacactttgggaggctgaggtgggcagatcacctgaggtcaggctgtctcgaattcccgacctcaggtgatccactggcctcggcctcccaaagtgctgggattacaggcgtgagccaccgcgcctggccaaaacctgtgatttagagagctctggtgactgcgatgctggattagaaggaggagctaaggactagaggttgtagagtaattagtggaagatgatgagggcctgacctaggctggtacagtggtaataaaaaaaagaaatggatgtcactgcacgatagaatagacaggacttggtgaccagcggagtgtgtgggaaggttgagggtgaggagaccggaagagtctctgcagagtctctcgaggatgcacaggtggatggtggtgccttccgctgagataggacatctgggaggatgagcagagccgatttggggtggaaggcaatgattttaggcttgaagtaccgagtcgcgggtgcctggagtatatccagagggcagaaagcaagttacatcaaaggggtaacgaaggtgaatgcttcccgaggccgggtaggtgatgtcaacaggtcagactgaagcagacagatgatcattttacctgtgagtcaggtcaggctcctttctgaaacgcccggatggcttcccattgcacttacgtcaattccgcatttctttccatggcctgcaaggtctgatttgaattggccctgcttttttttcccacctcatttactacacatttttctctctgactgtgttccagccacagtgatcttagtgattttcaagcatatcaaatttgttcctgtgtcagagcccccttctccctggccaagccctcgccaccagatgttctcccactggttcctcatcaggtagctcgtagcttgcctggtatctcaaggaagccttcctgcctataccgccgcatctgaagaggttactgtgtccaccctgtcttgggtttttttccatagcacttgtcactacctgaaatacttatgtgctatctccctccttccattcattccatgaggccacaagtgtgttttgctcatcagtatctctcattgcctagcgtagtgttgggcatgttccacagcatggagagccagtgcttctgggcattgcagtaggtaccagtgagaaaaaaggggaaaatctgcatattgagtatttattaaaaaaaaatatgatcatgacagggaagtcagtggtaaggtatcgcagagtggttgtcagagggtcatcgatttggccctgcttggggtaattgaagtgtgctagcgaatctaattagtccttgcggtcgttgctgtggggtcagcgagatggaagggtcacagaacactgacttcaaaggagcaaatccagagggcctgtgtgagaggagtctgattgggaggctcgttcctttcactccaaattacttatcctttcaatcccttgacttccacaggaagctcttttgaggccggaagctcttttcaggtgttgc

SEQ ID NO: 52823 - DNA, 379 bp, Homo sapiens
taacaaatgcctaaataactaatggatcacagaaaaaaaatcacaagggaaattagttaagtttcgaaatgaattaaaatgaaacacaatataccaaacttatgaaatgcagcaaaagcaattctcagagagaaatttatggctataaacaccaatactgtattacaaaaagaagaaagacttcaattaataatctaaacttccaccttaagtaacttgaaaaagaagaaccaactaaacccaaagcaatagaaaaaaaggaaataacaaacaaataaataaaacagagaatagaaaaacaatacagaaaaatcaatgaaacaaaaagttagatctttgaaaaggtcagcaaaattgaaaaacctttacctaaactgac

SEQ ID NO: 52824 - DNA, 417 bp, Homo sapiens
ttttccctttttttgggtgattagataacttactgtccaaactgtgacacacgtgagaaaggggacactaatgagataaaacaatgggaaagcagatgcaaactggggtagtaccctgcaaactggcctatggtcaccccactcgtcattggcccagtgaattcatcatcactgtgatctcactacctaacactcagtgcgtgcttcaaaaatcttagctaaaatttattatgtactgtacgatctattgctgtttttactgctctctctaaccttggtcaccacttacacatatagaaactttgtgtcagttacaaaatgtgccctttcttcttgggcagcaaattccagactatatggtgaatggacaccaggctggatttcacaactttcccctcccatgaacatttttgtgta

SEQ ID NO: 52825 - DNA, 152 bp, Homo sapiens
aattagattcagctttggcagttttatgcctagaaatgcaaaagaattttaaaagctcataagtttggcatttttaaaggagacattgtttgctttatgttgcagagccaatttttcttcctatcataaaaggccagaaacacagagaaagc

SEQ ID NO: 52826 - DNA, 316 bp, Homo sapiens
ctttaaagaaatgaaagaaaccctggtgtttctgtacagaggtgaggccagggagggggcagtgaaaagtaaggtcacctaaggcctgagacatcgggttgggtggtttggcctttatcataggagtaatgggaagtcattgaaggtttttaagcctggaggtaatagaatctgatttacattttaaaaagattattctgactgctgtgctcagcatggatgatgggaagacaagagccaaaatagagagaccaaaattttgcaaggatatagatttatctgtaaccatggggaagatgttcaaacattattaagt

SEQ ID NO: 52827 - DNA, 272 bp, Homo sapiens
aatctgcctgcctcggcctcccaaagtgcagggattacaggcgtgcaggtgcctggtcacctgcaatttttcattccattcatggttactcccctttccccagtcccaaattgaagatggtttgatttacaattttttgactttaccgtgggatgaaagccatacaaattcagtagaaattgtaattcaagaacccataggggctgggcgcggtggctcaagcctataatcccaacactttgggaggccaaggtgggcagatcacgaggtca

SEQ ID NO: 52828 - DNA, 195 bp, Homo sapiens
cttctgttattttgttaatttttaacttcacaactgatatatgaatatgttcttataaaagagtcaaacaagtctgtaatcccagatacttgagaggctgaggagggagaattgcttgagcccagaagttcaaggctgcaatgagctacgatcatgccacttcactccagcctgggtgacagagtgagcccctgt

SEQ ID NO: 52829 - DNA, 325 bp, Homo sapiens
aagagtgcaaggctgcagtgagctaccatcgggccaccacagtccagcctgggtgacagaatgagatccatctcttaagaaaacaaaaaacaaaaattacagtctttaggttatgatctacattcttacctgggatctgtttctggatttagggttttgatctatataaatacttcggggtttcatcacttttaaaaactgacctggccgggcatggtggctcacgcctgtaatcctagcactttcggaggccgaggcaggcagatcacctgaggtcaggagttccagaccagcctggtaaacatcgtgaaaccccatctctact

SEQ ID NO: 52830 - DNA, 1502 bp, Homo sapiens
tttttttttaccaagaccaaaacagccatttcaacttttctgcaagaatggtgcttatggcttctacgttaccggaaagcaaacttcaaacaccacacaatacaacagcttataaagaatatttaggcccaggtgttgatactttttcttctgcaaaattgttccagaagctgtactgtctttctagatggtggtatttgctaacatcatatccaactcagggaagtggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatatttg

SEQ ID NO: 52831 - DNA, 964 bp, Homo sapiens
tggagagggacaggaggaaacgcagcgccagcagcatctcatctaccctccttgacacctccccgtggctccagcaagccctagaggtcagccttgcggaccaacaggaggactcccagctttcccttttcaagaggtaccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctgtgagtccaatccgagggacctgggcatgcggccagacctgatgagcctgacggcgcctggaaattgtgaagaggcggagttagagttccctggggttggaagcttctt

SEQ ID NO: 52832 - DNA, 447 bp, Homo sapiens
accagctggccactgctgggcagcctgctgcagattctctggaaagggggtctcaagaaacagcacgacaccctggtaaaccccttttcgcgcccctgactctctcctccctcttccgccctcccagtggcgctccaaaccctccccgacatgcgcgcctcgggcgcatggtgcgcttcggcgtctgggcagggagggtccccggtcccctaggaggaaggaggcgggaggagggaaagcgcttcgggcacggcggaggatgcgcgctgacaccgcgctgtgcccggccggctgcaggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcc

SEQ ID NO: 52833 - DNA, 3278 bp, Homo sapiens
  misc_feature (1572)..(1572): n is a, c, g, or t
  misc_feature (1576)..(1576): n is a, c, g, or t
tggagagggacaggaggaaacgcagcgccagcagcatctcatctaccctccttgacacctccccgtggctccagcaagccctagaggtcagccttgcggaccaacaggaggactcccagctttcccttttcaagaggtaccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgtcgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcaggaccacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacgacagcaaacagtctaatgtggattctctacaatttatcccgtaatccccaagtgcaacaaaagcttcttaaggaaattcaaagtgtattacctgagaatcagagtgccacgggcaggaagatttgaggaatatgccgtatttaaaagcctgtctgaaagaatctatgaggcttacnccgngtgtaccatttacaactcggactcttgacaaggcaacagttctgggtgaatatgctttacccaaaggaacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttggattgtccgcaaatacgacatccaggccacagacaatgagcctgttgagatgctacactcaggcaccctggtgcccagccgggaactccccatcgcgttttgccagcgataatacgcctcagatggtggtatttgctaacatcatatccaactcagggaagtggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatatttg

SEQ ID NO: 52834 - DNA, 1871 bp, Homo sapiens
tggagagggacaggaggaaacgcagcgccagcagcatctcatctaccctccttgacacctccccgtggctccagcaagccctagaggtcagccttgcggaccaacaggaggactcccagctttcccttttcaagaggtaccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgtcgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcaggaccacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacggtaagggtgggctggatttgagtttgctaaatgaacggtctgtaccatttttagatgacagattttaaatagtaattcatctcattcatttcactgggattcactagcatcaactccacaaaaatgaaaagtctcatactagatgccacggtgcctccgcgcacagcatctatgccacggtgcctcagcgcacggcctcataccagacgccacggtgcctccatgcacgggcttctgtgcttaaactctgggtaggaggagacttcatgtgccccagtgacaaaaagccagagtaggatgtgatgagtgccatgatgtccatgcaaactgctacgggagttcaggagcagtaaagttctctgccctggcaagatacagaatccagatttttcaaaattggaagtattttgttcagttgcacatgttaccccaaagtgcctaactgtggctgttacttactgtaaaaaaaaaaaaa

SEQ ID NO: 52835 - DNA, 357 bp, Homo sapiens
ccaaagcccaagagttttaaattccaggtagttttttttttttttcaaaagaaaaatacatgtcaatgttacctagaggaaaaaaggaaagaaattgcgaatacctaaattaacatacactgtaagaaatcacttttagcagtgtctataagtcaaaatatctttgacttgcacatatgtatatatatacacacacacacacatatcagaaaaataaatggcaaattctgcttgcagctgcagtgttttctggatggctgcaaattaatgtaagtctttaaactttagggtacacaagactattaagtatctttctttgaagtcatataaatgtagacaaatttcaaatgtattgcc

SEQ ID NO: 52836 - DNA, 752 bp, Homo sapiens
agaaatggtgtttgaaagctcctttcaatatagagaacccccttacctgtcagtgcccaaaggcccccaactggggagatctgaagtgagaggaggaagctgcccaggttttcctgtccctggagagccatgggtcctgaggattggagcttatcattgagcaggctgttgtcacatacacagccttccagcttctattatgatgcattgtactgtttatataatcttgtatttgggaaatgcctaattatattttttaaaattactccaatatctgtcactgttagataaacacttctagaatctcattcccagtgttttctttctcctggcatgggtcaacaaccttcctgtgagcatattttcattatataatggcccctttatttacatatttactctttctaaaaggttaatttctttgtggggagggaaggtgatatatacacagtgtaatatttaaactgtacaagatggcttatttggaaaggaaatctcttcacgcctggcctttgccttcaagttctcttccccagaggcaatccactggtaacaattccttgtatattttagcaaagatacgctagataaaaatactcgtacatatattctttctctacctccccatccccctttaagaagaagcacactatacactgttctttactttgcttttttcctcaatatatcctggagatcaggaattcaagaccaggctgggcaaaatagcgagaccctgtctctaaaaaaaa

SEQ ID NO: 52837 - DNA, 350 bp, Homo sapiens
ctttacctagtacagaatttaccttacagtattgtgtaagtatagtttcttaaagagagaaatattagccgggtgcggtggcccacacctgtaatcccagcactttgggagaccgaggcgggtggatcatgaggtcaggagatagagaccatcctggctaacacggtgaaaccccatctctactaaaaatgcaaaaaattagccgggcatggtggcacgcacctttagtcccaactacttaggaggctgaggtaggagaatcgcttgaacctgggaggcggaggttgcagtgagctgagattgcaccactgcactccagcctgggcaacagagtgagactccatttcaag

SEQ ID NO: 52838 - DNA, 564 bp, Homo sapiens
tccatgatggtgacattttgccgtcatcgtctttacggcatacccgccctgcatctcctgcgagggctccttgcccctcctaagaccctccaggtcagtgtgccattcctgtcgcatcagctgcatcagtgcagacagaggtgaccgctcttttggcagacctccctgaggctgaaccctggagaaggctggatgtaggccgaggttccagagtgtggggtttcccgaaggttccctcttccctcaggcctgaactttcccaatcagtaacccagtggagcctggggccctgccagaccagttcctcctgacccctcatatctgagagtggctccctgagctccaagctgagccagagccagccccagccaccatgctggggaccagagcgtggggggcagctgcagatccaccccacgttgtgcctttgcagaagcgcaacacagcaggattcttaagttctttattagagatatttttaaaaggcttttaagtatttttttcttcccccacaccagcaaatgaaataattgcataattagtaataaatttgttcctacacta

SEQ ID NO: 52839 - DNA, 310 bp, Homo sapiens
gtatctggatgcaacaaaaaatttaaaaaaaaaattgtttctgaatactagaaagtcaaaagacaagctaaggaaatgaagaggaagattctgaaagaaggaaacaaataatttggcaaagtcctgctttagaccttgaggcaacaattaaatttgcagacaggcgcccacattatgtggcccaggaggttatcaatttggatatcatacagtctgtttctgagagagaccaatgatacataaacaaacctatcctcagggattgttctaaaaagcaactttcaggcatgtcattgggtcagtacatccc

SEQ ID NO: 52840 - DNA, 233 bp, Homo sapiens
ctgggatggcattctgattcctgatttccctggtcagaaatctttgttcctggatttgttctcacgttaccttgcgtctctgtggaagcatttatttgccatattctgcaaacatgttgtcgccagatagattgaatgctacccgaaggtttgtcacagtgctgtgcacaaagtgggacttcaagtgttatggaggcctggaaagccaggtacaatggctcacccagcacttt

SEQ ID NO: 52841 - DNA, 358 bp, Homo sapiens
atattttacattctttcttttggactaaagcttcaaaatcaagtgtgccttccatgcctacagcacagctcagtttggattggctccatctcaagtgaccgaagatacacatgcgtggctgccatgtgggacagcgagctccaggccaccctggccttcatctttcacccggggctcctgacttctaacttcaggcttgctgccctctcctcccactgtggccccattcctgtctcctggggtcctgttggtttctgagagccctccaggctcaacctaaaggcagactctccaggccgccagtgaaatggtgagtgaaattgtaagcatgaatgtatgcacgttttcctggaaaagg

SEQ ID NO: 52842 - DNA, 324 bp, Homo sapiens
ttgttctaaggtaccgccattcattgttattattttaaaatacgagtgtcgactgatgttaaaacacaaaatggggccgggagtggtggctcccgcctgtaatcccaacactttgggaggtgggtggatcacctgaggtcaggagtttgagaccagcctggccaacatggtgaaaccccgtctctactaaaaatacaaaaattagctgggcatgtgttgcgcgcccgtaatcttagctacccgggaaactgagtcaggagaattgctggaatctgggaggcggaggctgcagtgagccgagatcacaccagtgcactctagact

SEQ ID NO: 52843 - DNA, 145 bp, Homo sapiens
gcactgttacgaaatgtcagggattatgctgggttcttccaaaaattagctcatggaatcctcacaacagccaaatgggaataggcgttattattatcttcacttaacagaggaggaaatggacactcagagaggttgggtaact

SEQ ID NO: 52844 - DNA, 119 bp, Homo sapiens
gaggaaactgaggtgcagaaacgctgcatgactctctcaaggtcattcagcactgaggttagaaccccggcagctggattccaaagcctcacccttccagcgccaggaaagactacatg

SEQ ID NO: 52845 - DNA, 284 bp, Homo sapiens
tccctgggttttcaaaaaacaacttatttgtttcagtatatgtttaatttggcacaaaatctttctacagtcctatatttttaaagtttcatcttaatgcatttccatcctgctggaaaaaaaaattaaatgtaatcagacattttgtatacagtgatgaagtggttaacatctgctttgaagatgatactttaattaataaagcatcataaaaatatctggagtaatgtctgtcatgaagtctattcatgccacatgatcaatgggggatttctgttcgctct

SEQ ID NO: 52846 - DNA, 336 bp, Homo sapiens
aaattgcacacacataactctgtggagtgtctaatagtcaaaaataggttgagtgtgatcaggataaatagctaatgcatgtgggacctaatacctaggtgatgagttgataggtgcagccaactaccagggcacatgtttacgaatgtaacaaacctacacgtcctgcacatgtatcctggaacttaaaataaaataaaatattttaaaactaggttgagtatgaatgagagggaaaacagaagtgagccagttcataattataggctaaagattatagtgaaatcagatcacatcttacatttcacattattttttctgtacttagacattaag

SEQ ID NO: 52847 - DNA, 272 bp, Homo sapiens
actggaggaacagggcctgtcacataacacatagtcactgaataaacaaaagttaacaaatattgatcatatgtagggacatgtgtctagctaataatgttactctctggccaaccctaaacttagaaaaatccccaaagcttcccttagcctgtttaccctactttggatcttaacttaaagggggcatatcaaatactaggacagtgattctcaacctcagtgacacatgtaaacagcttgggaactttaaaaattctgatgcccaggcc

SEQ ID NO: 52848 - DNA, 402 bp, Homo sapiens
cttccacatatagtaaggagcaagttgttttatctctagtttgtatatagagaaacttaatcatacatatggaaacaaaaaaagtctgtttatattcagttctactataatatctcttaaaattaatgttaagcagagtggactttcttctacaagaaaagctgggactactataacatgtcaggataaagaatcctatcaagctacacagggtgctagaaatgccaaaatggcattgaaggcattcttcacccactggtattcagcaggcacagaaaaggcttaaattaagaaatctcatacatgagatactttgaattctaagtcatgtgggtgttcctctctgtgattctgtatccacacaaaatttttattaaataaaaaacatgtcatattttgaga

SEQ ID NO: 52849 - DNA, 404 bp, Homo sapiens
ggaattggcagtagttgaataatctgaggtgaggaatatcacttctaaaattactatatttaaaaaggtgtaatatcttcccatcttgttttttggccttatgctcaatgggtcctctgtaattaatattatatatgacacactggtgcttttttatgaccccttgaacaatttcattaattgaatcaacctgcataaaataaacattcctgactctgtcacatatttgtctttatatgtttatatattttttaaatctttaaagttttaggcctgcaatatatgtaatttgagatgatgagagctagtttagttgtagatattttcattgcagaagagcatgtgcagcagggaggaagatggtggattctgctttctttttttttgtttgaaactccttctcc

SEQ ID NO: 52850 - DNA, 520 bp, Homo sapiens
tacaaatttaattctattgctcttatgatgaaaatacaactgcagtgaaatgataactttttggagtctccatagatcatacaaagagagaacagagaaacaaggcaacaaattgggatacgctgcaacactctgcactgaacatctgacttcaattagccaaccctcaatttccaatacaaaaatcacaaaaggattactaagggagaatttataatggaaaagagattcagcctatatttatcctgatgtggctgtgaactggaccatctgctataggaaggagcacctgaagacttgttggctgaagttctctgtctggcctcgaaagacattcaaattagccaccactggagtagatgacctaaaagttcttacaactctcaattatacccagtgatgtctcgattagcacttattataaaaattaaaatttataattcaaaatttataccatccagaaaaagttaaaatatattaatagcctatttctcttcaataaagcgtatatataactcta

SEQ ID NO: 52851 - DNA, 472 bp, Homo sapiens
ctgctgttccactgggagctgaagccagggctcatggtcactcgtgacttactagtttgataggctctcactgtggagctagactcgtttgcttgttatttcttaagaatctctgtatctttctccttttttaccttctgtggttgtgatctgtgaggaaaaatgtgtatttctcccagattcagcctatatttatcctgatgtggctgtgaactggaccatctgctataggaaggagcacctgaagacttgttggctgaagttctctgtctggcctcgaaagacattcaaattagccaccactggagtagatgacctaaaagttcttacaactctcaattatacccagtgatgtctcgattagcacttattataaaaattaaaatttataattcaaaatttataccatccagaaaaagttaaaatatattaatagcctatttctcttcaataaagcgtatatataactcta

SEQ ID NO: 52852 - DNA, 366 bp, Homo sapiens
atgagggggaaagaaaagagaattgtttttgagagtgagatatctgtttctcttctctatgtttaactgtgtatgtatagccatccatatcagtatctgtatttgtccttatttatctacttttatctctgtttatctttaactatgtctatctccaaagaaagagtatagcttttggcttagagcatagatcctggatctggactgcgtaggtttaaatcccagctctccattttgagcattgtgcttttaaggaattgtaattttaaataagccacaaagtagcctccaggtgaggtgcacacctggacctatccctgcaaaatcactttcaaaagcagggaagggatagagggcctgtccttt

SEQ ID NO: 52853 - DNA, 205 bp, Homo sapiens
cgcttacttagacttgccgtgggaccttagtaaactaggtggctttacttgcatcacccttaatattatctacattattaaggggatattatctatagtattttgttgttgttttgagacagagtccactctgtcacccaggctggagtacagtgacgcaatctcagctcactgcaacctccacctcccaggttcaagcaattct

SEQ ID NO: 52854 - DNA, 462 bp, Homo sapiens
gttaacaaaatacagaactttcctgaagttgtcagtctttcagttaacctgttaacagatgcctaatccatgaatctgcccttattaatagtaaagaaagctaccatctctcaagcactgacctggggcctcccctgggctaagcgttttgactcgatgacatagcaaccctgagaagtaggtaccattatccccattttacaggtgaagaaaccagggctcaaagttaaggtcacataactagtaagtaaaaaactggaactcaaacccagagcttccagactccagaggccacccttgcagcgttgagactggcacttctccctgtagtgttcttgattccagaaagagctgaacacaggatccagaggccggacctcagcctccaagaagcagtgctaatgttctgtgtacttaagtgggttcctttattcacacatctcccacaaattaaataagtaa

SEQ ID NO: 52855 - DNA, 478 bp, Homo sapiens
gcacgagctggaagctctccttgcatttttattggttttgctttatttgaagtttgtttttgtccattttacttcatggcttttatcagtgtatctggtgtgtcatttattgctctttatcttgatttttttaactttttaaaaatttgcaaaatctatgaaagtataaatcagtataataaaactccttggatgggcacagtggtttatgcttgtaaccccagcactttgggaggtcgaggcaggaggatctcttgagcccaggagtttgagaccagcctgggcaacgtgctgaaaccccatctctacaaaaaatacaaaaattacctgggtgtggtggtgtgcacctgtacccgagctacccgggaggctgaggtggagaatcacctgagcctggggaggtagaggctgcagtgagccatgatcacaccactgcactgcagcctaggcaacagaatgagactgtcaaaaaagaaaa

SEQ ID NO: 52856 - DNA, 419 bp, Homo sapiens
atatcagtatatcgtgaagtaactgaattaaagtgcctgtcacagttttctgagaattgaattaccatttttctttatgaagacaaaaatgcctccacatgggaaaacaacctgaataaagtaaataacttatttgtgtactttaacaataaagaatggctcacaaatttggcttatttgccaaatgctttataaagactgagcagttagtaacaaatggcaaatggagtgctattgctgtatattggcagggctactttagggcatattactgatgataaatgtgaaggaagcacaggttagctcacctttactacatgaaaaaggaaggggattttatctggagtatttgaatagattcacacaaactatgacagaagtcttccaaactgtctgtactgataaacttcactttagga

SEQ ID NO: 52857 - DNA, 205 bp, Homo sapiens
ggttcccctgaattccgaggcatcccacatttcacatgagcaaatagccttgacacctgccgcgtctccaggacaataggcatttctgacccacatgatctgcacaaagaagaaagcctctctctctttctcaccactgcatccccaactgatgtggaccgtgatacataattggagttaaataaatagttgaggttgtcctggg

SEQ ID NO: 52858 - DNA, 578 bp, Homo sapiens
gtaaacaaaggaaaacaaattcatcttataaggaaattgagtttactaaaaattattataaagtctttacagaaatttgtattttactttggcaaaagaattttatatatatgtattattgaaatgctttgtatagtgaacacagggaggttgatttaaaacaggctatttgataaatttgctgagtgtgtacctctctactcagtttgtattaccgttttgacttttctctgcagcaattgtctctaagataataaaacctggcgagcatttatcatgggatacaatggacactgattttatgaaattgacttcagagaaacccttgtgctcacaggcatgctgagctcagagaggtcctgccaccttcccaggtccagtacaacaatcttacaggtgtaacagcagattcgtgaatgaacacaaaaggcctgtgctcacaaaggtcttttgttcatggacagaaccacttagactggcaacagtctacatttcactagtgtctttctttgttcgtttaaaacagtaaatccagaatgagtccagtgacagtaataaaggaagaaaattagcactgc

SEQ ID NO: 52859 - DNA, 294 bp, Homo sapiens
acaagccctatcagcacatcccagaaaatgggaaaccgaatcacccaggggatggcaaggaatgaccagagggaaagttccagttctgtccaacatgcactaccagccccattttggaaaagaacagatttaatagacctcaccaagacaagaattgtttttcgtcaaaggaaatcaaaggaacaaacaagaggcagtgaccaccagagacttcaccttttggtgtaggaaaacccaagcagacagtgtctacatccatcaaagcccaatgtattaaatatttattgaataaga

SEQ ID NO: 52860 - DNA, 372 bp, Homo sapiens
aaatttaagcagtgataaatttgaggtctctactgttcatttgtatgaagattttcttatgaacttgatgtcagtcctttgattagaaaattgatttttatgactttaaaatggtcataaaatcacagtgatgggatgaaactatgatccagattaatttcttactttataaatggagaaactgagcttccccatttaaagaagttattcaaggtctcacctctcattggtaacaaaagcatggataggaaaccagatcctctgactcccagtccattactcttttatgccacatcaattgccaagtgataaattttctctgggaaccccaggcttgtccccacccccattcccaaccctctatttatgcat

SEQ ID NO: 52861 - DNA, 312 bp, Homo sapiens
agtaatttgaagtcattactaacaacaagtaaaagatatatactaacttaaccacatgacaggcactattctaagtgctttacaggtacttgcccatttaatcatagcaatcaaatgggctagatagtgtggttatccccagtttactcttgagtagcctgaaacacggaaaggttatatgacttacgcaaggtcacatagcttaataagttgagaagccagaaactgaacccaagctgtctggttccagagtttgtactctaaaatactagcgttaagtgggcacagtgactcactcctataatcccacca

SEQ ID NO: 52862 - DNA, 682 bp, Homo sapiens
attcgcaaatgaaagactattttccagacttcccaagctaccaataaagaaatttctacatgattttaataaatacacaaaagttaccgaagttgaatgataacgtttaagtaaaaaggcttagtataagttcgtgtcccttcattggttcaagaacctcttaagtctgaaaatttttcaagtcttgaaaattgtaaaacaaggataattgagggttttataagaggaagtaaaaaagaagtttgacatgttcaggtgaaaaagtaaaactaacactttttcttatttttaagtgagggatctgactccttaattttctagtttttcttttaatcaagggctctattactgtcaccattgagaaattgtaataatatcaagagacatgtaggtaagtggtcactttaggtacaaaatattgattgggttaagcccagttgctggcattggttgggtgtagagagtaacaaaaaaagaaagaaggacgtagatatgactatttaaaagaggctcttaattttgtaactcctgttatgtgaatctaaaggtctgattgttaaagcagttgaacccaaagttcttgttttatgtggcttactcatggtagtttggcattgctaaccactctgggcttgcaactttcttgttaatttttgcaacattattctcgcttgattttttt

SEQ ID NO: 52863 - DNA, 430 bp, Homo sapiens
gcataattttactaaatagtatttcacaaatattaaagcacttgaagacaatggttatagtagatttgattaccaaggatcactatctgtactggagattagaacaattatatgaccagaagcatctaaccattatgtaaaaagaaatgatgagacaaaaagattaagatacaaattttgtgcagtactaaagaaaaagcagtctaccattgtggtccttgaaaataactatagatatttttgttatttgttagacacaaattataattttgttgttaatgtatttaagcattttatagttatgctttgtgtttttgatattctttgtattgttaataacaagtgttatgggtttttaatgttgaaatcatgtgttaatttttgtacttgaattcaaattttttgacattaaatatgtgatgcttcaaaa

SEQ ID NO: 52864 - DNA, 393 bp, Homo sapiens
ttacaggcgcctgccaccatgcccggctaatttttgtattttttagtagagatgaggtttcaccatgttggccaggctggtctcaaactcctgacctctggtgatctgcccacctcagcctcccaaagtgttgggattacaggcgtgagcgaccgtgcctggccttctccactgttttcatagtgaagaaaggacacccaaattttgatctggttcagctattcactattctatcctgtgtggtcttaagcaagttacataacttgcctatatctcagtttacttagctataatataaattaattggtcaaatgttctctaaagtcttactagttacagtgttccatggcccaacagcatctacattacctgagaggctggtagaaatgcaga

SEQ ID NO: 52865 - DNA, 258 bp, Homo sapiens
caaagataagattggactatgtttaatacacttcagcttttcttttaggtcagaacaggaggttggcaaggcaactgttgcatatgctaaaatctatttcccaaatcgctccccataaccgatggtcgtttgggctttcgtcttaccccagcctcttatttctgctttgagaacacctttagatttcagtggcgtctaactgatttagaagacattgggtaaagtagtcagttctgttaatttgctgtgaattaaacc

SEQ ID NO: 52866 - DNA, 542 bp, Homo sapiens
caggactgaagtgacggcgaggactcagctaaactggagggacagtgttgaccatggctatgggaccaagaaccacactgtggggtatgtccttctgaggacaggtcagccttgtttccgtccattgagtgtccgtgggcccaatgttatgaaatcttgttccctcatcttatccagagggagctgtgatggttaaattttgtgtcacctttgctggctgaggggttcccagacactgagttaaacattatttctgggtgtgtctgtgagcgtgtttcccgcggagattggtggtctcagtggactcagggaaagtaggtggcccttcttcatgtgggtgggcttcatgcagtccctcgaggttcagtgcagaatagaacaaaatggagatttaacctctcggcgtggctgcgtgagccgggacaccaaccttctcccccacttgggctgagactgagaccatcagctctcctggttcaagggccttcagacttggactgaaccacaccgccaggcttcctgagtctccagtgggcagaagg

SEQ ID NO: 52867 - DNA, 285 bp, Homo sapiens
gtcggaattaaatcacatcaaaacgccccctgaaacccacatcctgaaggagtgaacctacaacagccaacctccagtcgttcgctcgagttcacacgaacaacttgcctctaacatccgagtgaagggggcggcgggtgcctctcccgcaccgcacccaccacatcccggacctgggatcccactcgcacccgaagaggcggctgcttatgttaatatcagcccccacacgaattagaaaagaccgcccggtgacagaattgcttatgccaggaactacactga

SEQ ID NO: 52868 - DNA, 294 bp, Homo sapiens
acaggttcaactgtctctacagtgctgtggctgtggctggaagtccatggggtgggaagtggagaagaggagatggatgtcaagtggaaaagagcaaggacaagctggaccccatgaggatgatctccatgtgctgcaggagaaatgggtgtcctttgtcactgagctctgccacggccttcaggatgctgaagaaggatccaggcagaggcaaagcacttgcaggcccgcccaccacactctgacaatgaaatgagcctggcgacactgcctgacctttggagcttgacttct

SEQ ID NO: 52869 - DNA, 559 bp, Homo sapiens
attcaaatcagcaagtgtttattgaggaactcctataaataaaacactgctctagggattgtaagggatgtgaagtttcattcttgagctcgtatatagtagtgaatgaggcctctgtaaaataatcaccttgagctgtccctcacttaatcagatgattatgctcttatataaaccatatgaggagcagccttgtgaaattgttttcagaatttacagtatatgctttcagagaaacttagtgcataatcgtcataggtttaaggttggatttgatttagaaatagtcagaaaaaatttagaacaaaagatagtgattaaaggtagtggttagattttttttttgatgtccttgtaaccatgacattaatttacctgtgtgctttgtaaaaggacacttaagatatttattaaagaagagttgtggaaatgttttatctacacccccttccttttttttttaaatgacacaaacagattaacattctttattaagtgtttctttcatgtactttatttccaactccactgggattgaagcatttataatcttctttca

SEQ ID NO: 52870 - DNA, 516 bp, Homo sapiens
gagaataaccaagttagctgtatggatggctatgaggggtgcacacagcccgttcaccaactgaggaatggagaactcgaagggaggaacggagactcggccgagcctcagcactcacagcggcagggtggatgagttctaataagggtagtttcctgtgacagtccggaatctggaactaggcatcagcccaaatggctcctgcatgaaaagctgcggtggatctaagtggcagctaggagtcaaggcaactagcttcctccgaagcgaggcaagacaaggcacagccgagaagccactcaacctctgttcccaatgaatccatttccatgtccctgcttcgctgtacgacaccccacaccctgatgtgcatcttgtgaaaaatcaagatgaaaataaaaggtcaggagaaaactctgtggagactgttgtcaatgtagtcaaactgactctgatatagacaccttccgcattctgcacttactcatgcaatttcatttactttttagagagaaa

SEQ ID NO: 52871 - DNA, 627 bp, Homo sapiens
gagaataaccaagttagctgtatggatggctatgaggggtgcacacagcccgttcaccaactgaggaatggagaactcgaagggaggaacggagactcggccgagcctcagcactcacagcggcagggtggatgagttctaataagggtagtttcctgtgacagtccggaatctggaactaggcatcaggtgagagtgccctggagtggagtgggctgggggaagaggatggggcttgctggtggtgtaggtgtgggtgtggcagccaggtctccagtggctgcaggatcctgccctcagcccaaatggctcctgcatgaaaagctgcggtggatctaagtggcagctaggagtcaaggcaactagcttcctccgaagcgaggcaagacaaggcacagccgagaagccactcaacctctgttcccaatgaatccatttccatgtccctgcttcgctgtacgacaccccacaccctgatgtgcatcttgtgaaaaatcaagatgaaaataaaaggtcaggagaaaactctgtggagactgttgtcaatgtagtcaaactgactctgatatagacaccttccgcattctgcacttactcatgcaatttcatttactttttagagagaaa

SEQ ID NO: 52872 - DNA, 212 bp, Homo sapiens
ccaaacgacatggatttggaacttggattcaaactcaagcagtctggttccaaagatttcattcctaaccacttaagtgatagatttttcatttctgttcacctttagtattaagccaatacagtttgctttgaagccccagttccatctttttaagtaaatgtgggcaagaggcttagtagttatggctaattctggtttgctcctgctgc

SEQ ID NO: 52873 - DNA, 788 bp, Homo sapiens
atttcttcctaaaatgttaccaagcaactgttcttcatgttaatactaagattcttgatagttccatttaaaagccacaagaagtcattctggtttattcctcactccaagggaacacttactttgtgtagacaagaagatgagagtctttccttcaggatttctaaacacagagcaagaagattcaatgaaaaattgggctcagggcagtaattggggctggcatttattcttaagagttttctccctcaaaaggtgaaggagtgacattgcgtattcactctgtgtgtgtgtgtgtgtgtgtgtgtgtgtgtgtgtgtgtgtgtgtgtgtagctctagagggagtagggagaaaatacaggatgaaattgaaaacagggactaacaacttttcactgaatgccagcaagctctctaaaattagttttctttggttgaacaaatttacaattcattgtacttcatttcacagcattaaacatttactcgaggcagtttattctgtttgctctttcatcccccttcttatttacttttttcttgtgctctaaaacttttgtcaatctttaacaaaactgtgctgttaccttttttaatgttaaaagaattttaacactgtcaactgtagtttgtgcagatgtatgtcagaaaaaaatgtacagtatgtgtcaaaatatatttgaatatcttgttgctgttgctgttagttcctggctctctaattttctgtctgttagggagtttcttaagatttgaaatacaagttaagaactatggaaagcatatt

SEQ ID NO: 52874 - DNA, 831 bp, Homo sapiens
atttcttcctaaaatgttaccaagcaactgttcttcatgttaatactaagattcttgatagttccatttaaaagccacaagaagtcattctggtttattcctcactccaagggaacacttactttgtgtagacaagaagatgagagtctttccttcaggatttctaaacacagagcaagaagattcaatgaaaaattgggctcagggcagtaattggggctggcatttattcttaagagttttctccctcaaaaggtgaaggagtgacattgcgtattcactctgtgtgtgtgtgtgtgtgtgtgtgtgtgtgtgtgtgtgtgtgtgtgtgtgtgtgtgtgtgtagtatactactacgagagagaaggagaagaaaactaagagaagagaagagaagaagaagagaagaaaaacaggagatgagatgatgtgagagcgcatctctctcaacgagagctgatgagagagcgaacactactacaagcagcagagcagctgccacccatcacagagacacacactatacagcgagagaacagtagagagcgcgcgcgcacacacccaccatacataaaacagcagacgcgcgcgcgcggcaaagcgccgagacaacaactctccacacagaagagtggcggccgacaaccaagaagcgtaggaagaaaaaacgacgactgagacagagcagagaagggagcagtgtcgctgtgcgaccaaaaagacgagcagtggcgtggtagcatatatatgtcgagcactagcgagcaaaacaacaaccaaacaaccaccacaacaaaccacacaaaaaaaaaccaaaaacaacacacaaca

SEQ ID NO: 52875 - DNA, 311 bp, Homo sapiens
agattctaccttccactcttctgcctccagctgcccctgggtttacccgtcctccactcagtgcagaagaagctgccctgcgtcgggccctggaacacacggatggtgaccacagttctctgatccaggtgtatgaagcctttatacaaagtgagttctgcatccttttatagaatcccagattttccaaagaggggaaattttatgcagccagctgacagatctctatgctcagaaagaggaggccctttggctaagggttgggttatttcaggggtctcaaggactttagtttagctggtccctttcct

SEQ ID NO: 52876 - DNA, 345 bp, Homo sapiens
caaagtagctttgtcacccaggctggtgtgcagtggcacaatcatggctcactgcagcctcaacctcttgggctcaagcaatcctcccacctcagcctcctgagtagctgggactacaggcactactaccacgtccagcgaattttttattttattttattttattttgtagagacagagtcttattatgttgcctagactggtctcaagtgatcctcctgcctcagcctcctgaagtgctgggattacaggtgtgaccaacagtgcttgaacagaaagataaatggcaccaagaaaaggccatgtgaggactcatcaagaggatggccacctacaagccaggaa

SEQ ID NO: 52877 - DNA, 365 bp, Homo sapiens
aaatgttctttggccagaattacttggtttagtttatttcattctcctcttccttcagacaatatagacctggtatcctttagtcacttccctgacctttttctcattttgctgtgcagacgaaatccaagttcttatttagaaacctggatagcataagcctaggaaacaagattttgtgtttttaaaacttatgtttaagatgtgactcatacactctcctctgagaggccaaggacaatcttgatagtgtggccagatcccagcataattgcaagggagacaggggcttcaaacataattgcaagggagacagaggcttcagaatgcctccacccagccagcgttcaacacactctttgccc

SEQ ID NO: 52878 - DNA, 149 bp, Homo sapiens
gtccacaccgacagataccacctgccatctcccattttctcctcccccaacctccccagcatccctgatcacttcaagggctgctgagccctgggaagattttccacggaagaacttgtttaataaatgggaaactgacctttgctaaa

SEQ ID NO: 52879 - DNA, 311 bp, Homo sapiens
tctcaaagaaagtgaatgattcctgtaaacagggaactcctcccactggcccacttcctgccctcacacataagtgaagcctgatcattgaggcgttaccatcagcaccccccaccacccccacctgaagtcagggagaaacatcttggggaaaatgatctatacaatctgctgacattagctattctcattcttcactcaaaaatataaagaagacacaataattgccagacatttgagagaaataaactgcacatcaatagcacacagacacagagacacacacacacacacaaggccagaatgtacaa

SEQ ID NO: 52880 - DNA, 872 bp, Homo sapiens
aattgttcaccactttggcaaggtggatataatccgtgaatttgtattctcagagcacatgttgaccactggttggtaaagtggtccaggaagaacctctttatgggagagtgtagtgatctggggattcaacctttactgggcatgaaatgataggcagttaattgacagttggcagtagagataaaggtaattctttctttaattttcgggcttagagaatggcttatctccacggttgctttaaactcccagtactccagtgtggtagtgacattttggcctgccttttacagaggcagagtccatggtggccccaggcacggtctttgatttaaagtctgagctcctgatacccaggtgcgccctctgcaaagtcatgttctttcaggctaaataacagaagggtaaccttcagctgggttccctaagatgatttctttcgccagcaatcatcactttccccaccggtttttaatgcagccatttctttcatctgtattcctatcttgatttgtgagaaattaaatgagcatgtaagatgtggtttagataatgattaattaggggaaaaggcgtcattccaatagcaagtcactattatatgctaaggaaattagttcatatttttggatggcaaattgacttgtcctgcatttaaaaagataccttttaaaaaatgcctgttatggctttttttggttcattagtagagcaacctgcacttaatcctttggatgattttaataggcatctattattttccctacaagtcatgaagcaaccagtttgggatatcattaattcttttgtttaatattaatttaatgataatgcattattattttcagcacaaagtacttttgttagca

SEQ ID NO: 52881 - DNA, 454 bp, Homo sapiens
aggacgagtgtatgtctcctcgtggttgtgtggccaggcttttgtttcccttgcagcacttaaaatgctgggcatgcgtgtctagatacctcaccagatgtgttcccacccaccctgctggttgctgccacactccactgtgacttttcagagctcttgggctgtttctcttgcccttctcctctactggatgaccacctgctgtgagattatccctgggttctctgattatagcccaaggcacacctaagaagtttctagggaaatcagatagccagtaagtttttcaaacttgaattagatctcttttctgcccaatgtgactattctttggtgcacactgtaggaaaatcaggtccttcctgtgctaaacttaaactcgatagttgttgagtgactccttttactagtgatgattacaaatagagatccagagtcattttaatcatggttc

SEQ ID NO: 52882 - DNA, 241 bp, Homo sapiens
cgacatgagatcaatgaccagacagggtgctgcggcagaagaggatggcataaaggccagacagcttggtggagggtgctggtgctgggaagagcacagtttgaggctggccgtgtgactccaagccaattaaactctccgacctccttctgaacaggcaaaatggaggagcggaaaccaatttccctgggttgtggtaataagaactgaataaattaatatacctgcttggctcttcatg

SEQ ID NO: 52883 - DNA, 235 bp, Homo sapiens
caaccctagcagaaagacagaggaggtatttatccatccctgctgcttccttcctaccctagtctaaatccttgaccaagtagggctggataccaggattgagatgtcacaattttaaggggggtttcaagcaggggaaatcacaatacttcatcttctcttgccattagctttttctgttaaaaatacgatgtttaaaaagcacataaacatttatccatttatcatttacttt

SEQ ID NO: 52884 - DNA, 410 bp, Homo sapiens
aacaaaattacgaagatatgatttctttcattgttgtagaaccattaaataagtcatcagattatgatttgaacccagggcacccagtcaagtgctctttccctatgcggccttagctacggggatttacatttacagttgagaagtgaaacaagaaaaatttgtttttgaaacataatagtaccatctagcctggctgaccaacccttccccagcaccaccagtggacatgcgcatgtacatacacacatacatacccacactttaggctgagggagagtcttgtctttttgaatagccttcatagtaacctctgggattcaagggtacctgatatttaagacctttattaaaccttggttcagtggttttcaaacatttttgaatatcagaaccccttttcctaatgg

SEQ ID NO: 52885 - DNA, 977 bp, Homo sapiens
gcagccccacagcaccaaagagtcaatggtagttttggtcagaaatcttcagtgggccttttttgctcaatggataagttattttcatattttatttatttgtatgtttaattttaaaatattagttgacagataatattggatatattcaagatatctccaaatacacattgtgtggtaattgttacaaaatcagtatcatctgccgtgacttaaaagtttgtcctccgcctaaattcatgttgaaactttaaactccaaaacaatagtgttaacaggtgggggcctttaggaggtggtgaggtcataaaggctgtgccctcatcattgagatgaatgacttcataaaaggacttgagggagtgagttctgccctttctgcccctctgctgtctgtgaacataacattcaggatgtcatcttgaaagcagagaccaaggtcttcaccagagacagtctgccaatggcttgattttgcacttcccagcctatataactgtaagcaattgagtttatgtcatgtataaactacctagtcaggtattttgttaaagcagcaggaagggactgagacaacatctattgccacccgtgctgtacattagaatgccagaacttattcatcttataactgaaagtttgtaccttttcagcaatgtctccccatttcccctaccttctggcccctggaaaccactatgtagtctgtttctacgagttcaatgtttttaagctccatctataagtaagatcatataacatttgtctttctgtgtctgacttattttacttaatattctccagcttcatattttcacaaatgactttattcttttttatggctgaataatatttcattgcgtgtgtgtatcacaatttctgtatccattcatctattaatgagcatttaggttgtttccgtgtctttggctattgtggaaaatgctgcaataaacctgggattgcagaagtctctc

SEQ ID NO: 52886 - DNA, 2087 bp, Homo sapiens
cgaccattttttttttttttttaacaatcggatctttcaggaactaatagagcgagaagtcactcattaccacaacagtgccacttatgtggaatctgctcccatgacccaagcacctcacaccaggtcatacctccaacatgaggatcaaatttcagcatgaaatttgaagggagaaaatacccaaactgtattcaatactaagaaactgcatatgagaatattactgtattgttaatagctataggggagggagccatgttgtagactaatcaatccatttatgttcaatttgtttatgttagaaaacctgcactttctctgatattggtagcagtgtaagttcagacttagtaataaaagaaaataactaataaaccattaatgatggggttgtcattttttgcagaagtcatatgatagacatactgtgtaaaattaaataagtcagtgtagaaaaacctccagatgccaaattttaatctgaacaaaaaattcctgctagagtaaaaccacatgaatgcattgtgtgtgaaaaattcttcatacgttcattcatcccttcataggcacatcatatctcattctggaaacaacccatatgggtgtgaggaatgcggaaagaagccatgtacatgtaaacaatgtcagaaaacttccctttctgtcacaagggttcacagagacacagtaatgcacactggaaatggacattatggttgtacaatatgtgagaaagtttttaatattcccagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttgaaaaaaaaaaaattg

SEQ ID NO: 52887 - DNA, 971 bp, Homo sapiens
  misc_feature (642)..(643): n is a, c, g, or t
ctttgtctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagatgtactggttcatgaagatgtgcttatgggtttctactctactctagtaagttttgggtctatgtatgtacctttctttctctgcactcttggggcaaggaattgccatgtgattgatcggagaattgttcattttaaattagtccagaatttttatgttttatttcttctaaaacaaacgaaaacgggatacgtgtagaacatgtgagtttgttacatgggtatacatgtgccgcggtggtttgctgcacctattgacctgtcctctaagttccctcccctcaccnncaacccccaacagcccctggtgtgtgttgttccccctctgtttccatgtgttctcaatgttcagctctcacttatgagtgagaacgtgcagtgtttagttttctgttcctgtgtttgctgaggatgatgacttccagcttcatccatgtccctgcaaagcacatgatctcattcctttttatgtctacatagtgttctatggtatatatatacacatatatatatacaccacattttctttatccagtctatcattgatgggcatttgggttggttccatgtctttgctgttgtaaataatgttgcaataaacatacgtgtgcacgtg

SEQ ID NO: 52888 - DNA, 542 bp, Homo sapiens
ctttgtctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagatgtactggttcatgaagatgtgcttatgggtttctactctaatccttgaagaatcgccacactgtcttccacaatggttgaactaatttacattcccaccaacagtgtaaaagcgttcctatttccccacagcctcaccaacatctattgtttcctgactttttaataatcaccattctgactggca

SEQ ID NO: 52889 - DNA, 815 bp, Homo sapiens
ctttgtctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaaaacggctcacgtaggccgggcgcagtggctcacgcctgtaatcccagcactttgggaggccgaggcgggcagatcacaaggtcaggagatcgagacc

SEQ ID NO: 52890 - DNA, 806 bp, Homo sapiens
gcagccccacagcaccaaagagtcaatggtagttttggtcagaaatcttcagtgggccttttttgctcaatggataagttattttcatattttatttatttgtatgtttaattttaaaatattagttgacagataatattggatatattcaagatatctccaaatacacattgtgtggtaattgttacaaaatcagtatcatctgccgtgacttaaaagtttgtcctccgcctaaattcatgttgaaactttaaactccaaaacaatagtgttaacaggtgggggcctttaggaggtggtgaggtcataaaggctgtgccctcatcattgagatgaatgacttcataaaaggacttgagggagtgagttctgccctttctgcccctctgctgtctgtgaacacaacatctattgccacccgtgctgtacattagaatgccagaacttattcatcttataactgaaagtttgtaccttttcagcaatgtctccccatttcccctaccttctggcccctggaaaccactatgtagtctgtttctacgagttcaatgtttttaagctccatctataagtaagatcatataacatttgtctttctgtgtctgacttattttacttaatattctccagcttcatattttcacaaatgactttattcttttttatggctgaataatatttcattgcgtgtgtgtatcacaatttctgtatccattcatctattaatgagcatttaggttgtttccgtgtctttggctattgtggaaaatgctgcaataaacctgggattgcagaagtctctc

SEQ ID NO: 52891 - DNA, 1740 bp, Homo sapiens
ctttgtctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgatttccagtgctttcagtctcatccatcctctacaaaaatgtggaatattttagaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttgaaaaaaaaaaaattg

SEQ ID NO: 52892 - DNA, 979 bp, Homo sapiens
gcagccccacagcaccaaagagtcaatggtagttttggtcagaaatcttcagtgggccttttttgctcaatggataagttattttcatattttatttatttgtatgtttaattttaaaatattagttgacagataatattggatatattcaagatatctccaaatacacattgtgtggtaattgttacaaaatcagtatcatctgccgtgacttaaaagtttgtcctccgcctaaattcatgttgaaactttaaactccaaaacaatagtgttaacaggtgggggcctttaggaggtggtgaggtcataaaggctgtgccctcatcattgagatgaatgacttcataaaaggacttgagggagtgagttctgccctttctgcccctctgctgtctgtgaacataacattcaggatgtcatcttgaaagcagagaccaaggtcttcaccagagacagtctgccaatggcttgattttgcacttcccagcctatataacttatcatgccttttcttgcagatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaaaacggctcacgtaggccgggcgcagtggctcacgcctgtaatcccagcactttgggaggccgaggcgggcagatcacaaggtcaggagatcgagacc

SEQ ID NO: 52893 - DNA, 959 bp, Homo sapiens
gcagccccacagcaccaaagagtcaatggtagttttggtcagaaatcttcagtgggccttttttgctcaatggataagttattttcatattttatttatttgtatgtttaattttaaaatattagttgacagataatattggatatattcaagatatctccaaatacacattgtgtggtaattgttacaaaatcagtatcatctgccgtgacttaaaagtttgtcctccgcctaaattcatgttgaaactttaaactccaaaacaatagtgttaacaggtgggggcctttaggaggtggtgaggtcataaaggctgtgccctcatcattgagatgaatgacttcataaaaggacttgagggagtgagttctgccctttctgcccctctgctgtctgtgaacataacattcaggatgtcatcttgaaagcagagaccaaggtcttcaccagagacagtctgccaatggcttgattttgcacttcccagcctatataactatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaaaacggctcacgtaggccgggcgcagtggctcacgcctgtaatcccagcactttgggaggccgaggcgggcagatcacaaggtcaggagatcgagacc

SEQ ID NO: 52894 - DNA, 907 bp, Homo sapiens
  misc_feature (578)..(579): n is a, c, g, or t
ctttgtctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacactctagtaagttttgggtctatgtatgtacctttctttctctgcactcttggggcaaggaattgccatgtgattgatcggagaattgttcattttaaattagtccagaatttttatgttttatttcttctaaaacaaacgaaaacgggatacgtgtagaacatgtgagtttgttacatgggtatacatgtgccgcggtggtttgctgcacctattgacctgtcctctaagttccctcccctcaccnncaacccccaacagcccctggtgtgtgttgttccccctctgtttccatgtgttctcaatgttcagctctcacttatgagtgagaacgtgcagtgtttagttttctgttcctgtgtttgctgaggatgatgacttccagcttcatccatgtccctgcaaagcacatgatctcattcctttttatgtctacatagtgttctatggtatatatatacacatatatatatacaccacattttctttatccagtctatcattgatgggcatttgggttggttccatgtctttgctgttgtaaataatgttgcaataaacatacgtgtgcacgtg

SEQ ID NO: 52895 - DNA, 381 bp, Homo sapiens
aaagagcaaatgcatagcattggcactggtggtgtgaaagcacagcccaggatgcctcttcagtcacagtcacccactaaagctattcgatgagcacctagcatgggctaggtacctagaccaacacacagtttcaccaacatccctggctaaggtcacgtgatccacagagatgcttgtttgctgagcatgagtcagatctggagaaagtcctgagaaagtcccaaggcttctatgtctgaagttccaagccaggatggaagcagccaattcacctgctatagactaagtgtttgtgtcttcctcccctcaatttatatgctgaaaccctaaccctcatggtacttggaggtaggggctgggttagattaagtcatgagg

SEQ ID NO: 52896 - DNA, 1485 bp, Homo sapiens
cccttgaggcaggtactgtcacactgtccatttcccgggggaagaagcggatccagaaaagttaaactctcccagggccgaggatggaatcagagctggagctgtgacctggaaacccataaccacaatacagatgagccctgctgaggtgggggaagccttggattcctgaatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 52897 - DNA, 1379 bp, Homo sapiens
cccttgaggcaggtactgtcacactgtccatttcccgggggaagaagcggatccagaaaagttaaactctcccagggccgaggatggaatcagagctggagctgtgacctggaaacccataaccacaatacagatgagccctgctgaggtgggggaagccttggattcctgaatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 52898 - DNA, 1435 bp, Homo sapiens
cccttgaggcaggtactgtcacactgtccatttcccgggggaagaagcggatccagaaaagttaaactctcccagggccgaggatggaatcagagctggagctgtgacctggaaacccataaccacaatacagatgagccctgctgaggtgggggaagccttggattcctgaatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 52899 - DNA, 1534 bp, Homo sapiens
cccttgaggcaggtactgtcacactgtccatttcccgggggaagaagcggatccagaaaagttaaactctcccagggccgaggatggaatcagagctggagctgtgacctggaaacccataaccacaatacagatgagccctgctgaggtgggggaagccttggattcctgaatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcaggtgagtcaccatgaacacaacaggacttgagggccagctgactaggacaagacatgtatccttgctgccccggggcctccatgccgagactccatgccctgactccaacaggagcatcaccaaactacacctggaggaagagccaggacagaggaaatggccccgagaggaaacaaagctaggcacagtggctcacacctgtaatttcggaggctgaggcaggtggatcacctgaggtcaggagtttgagaccaacctggccaacatgacaaaaccatgtctctactaaaaatacaaaacttagccggatgcagtgccacgtgtctgtagtcccagctactcgggaggctgaggcaggagaattgcttgaacccaggaggtggaggttgcaatgagctgagatcacaccactgcactccagccggggcgacagagcaagactccgtctcaa

SEQ ID NO: 52900 - DNA, 624 bp, Homo sapiens
gcggacggcgtggagtgactatcccaccgccgcgggattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggtggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 52901 - DNA, 309 bp, Homo sapiens
aggaacacgagatgtgagtaaggatacccccttaaaagaggtgttatactccggtgctggaagctaaagttcggaccacaaactagtaaaagcattctacgagtacaacccgatagctagccaggattcggagtctgaaacaacactcgccttttttgcttggcctgttttgactctgcagagcctgagatggacgtaaggaagagaacgtgagtgtctgcggccctggggcagtagtggcaattgggcggtgcggcagggacggggtagcagtggccaaaccctggaccaccgaggcactaccacaag

SEQ ID NO: 52902 - DNA, 749 bp, Homo sapiens
ccatgatcaggacatgggaaagacccccgggtgacaatccacttttcctccccagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 52903 - DNA, 1687 bp, Homo sapiens
cccttgaggcaggtactgtcacactgtccatttcccgggggaagaagcggatccagaaaagttaaactctcccagggccgaggatggaatcagagctggagctgtgacctggaaacccataaccacaatacagatgagccctgctgaggtgggggaagccttggattcctgaatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacctaaaaaaaaaaaaaaaaaaaaaaaacctcgagagggcacctatggcaggggggcgggaaacaggaggggactggaaagtgggcacaggggacaaagcgtgttccctggagcccaggtttctgggcacacacgggggaacgattgcgcgggcctccctaatagggagccgaataactcgcaaaaacgcccggaacccgggtagg

SEQ ID NO: 52904 - DNA, 1414 bp, Homo sapiens
cccttgaggcaggtactgtcacactgtccatttcccgggggaagaagcggatccagaaaagttaaactctcccagggccgaggatggaatcagagctggagctgtgacctggaaacccataaccacaatacagatgagccctgctgaggtgggggaagccttggattcctgaatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgatggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacctaaaaaaaaatagaaaaaaaatcggggttatggggggggaaaagggtaagactgggcgggaaaggtttgaacagtcttggaaaggaaattggggcc

SEQ ID NO: 52905 - DNA, 402 bp, Homo sapiens
gcatcagagaaggcttcccagcacaggagcattgtggctggggctttgcgggatgaataggagtttcgtagaaggcaaaaatggcattcccagcagagggcacagcaccagcaagcgacaagaggtgcaggccagtcccagggaagtagagagaggccattcttggccccagtcctgttgacaccttttccacctcccccacagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacc

SEQ ID NO: 52906 - DNA, 1580 bp, Homo sapiens
cccttgaggcaggtactgtcacactgtccatttcccgggggaagaagcggatccagaaaagttaaactctcccagggccgaggatggaatcagagctggagctgtgacctggaaacccataaccacaatacagatgagccctgctgaggtgggggaagccttggattcctgaatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacctaaaaaaaaatagaaaaaaaatcggggttatggggggggaaaagggtaagactgggcgggaaaggtttgaacagtcttggaaaggaaattggggcc

SEQ ID NO: 52907 - DNA, 1310 bp, Homo sapiens
cccttgaggcaggtactgtcacactgtccatttcccgggggaagaagcggatccagaaaagttaaactctcccagggccgaggatggaatcagagctggagctgtgacctggaaacccataaccacaatacagatgagccctgctgaggtgggggaagccttggattcctgaatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaacaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 52908 - DNA, 1468 bp, Homo sapiens
cccttgaggcaggtactgtcacactgtccatttcccgggggaagaagcggatccagaaaagttaaactctcccagggccgaggatggaatcagagctggagctgtgacctggaaacccataaccacaatacagatgagccctgctgaggtgggggaagccttggattcctgaatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaacaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacctacttaaaaaaaaaaagaaaaaaaattgtggggggccggccgaaaagttttaaaccctcggtggggggggcccaggttggaacggcaggtccgaaaaaccggcgaggggggttccccaaaagcccgggccggtggaaacgggtggcccggtcaaggcgc

SEQ ID NO: 52909 - DNA, 368 bp, Homo sapiens
ggttgaggctgcagtgagctgagatcgtgccactacactccagcctggatgacggtgacactctgtctcagaaaaaaagggaaagaaataattctcatttatacaggagagaaatcctatgaatgtaaggaatatgggaatacattcagtttccaaagatatgaaaagactaactggaaaaaaatccaaagacctcagatattccagttctattcagagccataaaaggactcatactggagaaaaattgtagaaatgtacagaatatggggaaactctcattgctctcatctccattcaaagacacgtgtcagtgcacactggagatggatggtatgaatcgaagaatacacactggatggaaacgt

SEQ ID NO: 52910 - DNA, 644 bp, Homo sapiens
cctggaggtgcctgatgtgttccaacagatgcgggagctgggcctggctcggcgggtgcccgacagcctcttccgttcgctgctggagcgctatctcacagcggccactgctagcgtgggctccggggtcccggttctctcgcgagtcccgctcaagcaaaagcagcctggtctggattacttctatccccagctgcagctgggcgtgacggaggccgtggtcataacccaagtgtgccatccccaccgcattcactgccagctccgcagcgtctcgcaggagatccaccgcctctccgagagcatggcccaggtataccggggttccacggggacaggggatgagaactctaccagtgccacctgggaggagagggaggagagcccagataagccgggctctccgtgtgcatcctgtggcctggatggacattggtacagagcactgttgcttgagacttttcggccccagcgctgtgcccaggtgcttcatgtggactatggaaggaaggagttagtgagttgcagcagccttcggtacttgctgcctgaatattttcgaatgccggtggtgacctacccttgtgctttgtatggactctgggacggtgggagaggctggtctcggtcacaggtcggtgacc

SEQ ID NO: 52911 - DNA, 237 bp, Homo sapiens
gtggtgcacagtattggatttgggaagagtgtggtctgaatattctctgaaagtaaaattttgccttgtcactctgctaccatatttcaaagcttaaagataaatatcctcataatgttaatttaatcaactaacattaattatctattattctccatatatcagggagaatgaaaaatacataagacatgaaacctattcagggaaaacttaaaatgtgaattgactctaaagtgt

SEQ ID NO: 52912 - DNA, 434 bp, Homo sapiens
gttttagattttctgcagatggcatagattcattgctgaatctctcaattcttgtgtttccaggtatgaaaacagagctgtatccagcaaggctggcacacagtggtctagcagtatcactggtgtgctctctccaaatgtgtttataggtgtttactttcaatcattataatcattataatttgttctctcagcccccataccaactagggttatcaggtgacataacagtgaaatctttgtgtcgttcatttgctaaggtctccatcaactcagcttggctatattgtaaacaggagcagacctctaaacccagtccctgtgagtgacccgactcaggagacgtggagtagccaagcatgatgaagtgcagcttccagagctggcggttgttgaagtcaggaacattcacccaaagatgtaacgtgatctga

SEQ ID NO: 52913 - DNA, 565 bp, Homo sapiens
ctattcctcagagaggaccccagagaataattgattttgcaggaaaatgggtttgattttggttatctctctgagtggggaaaacaatctgatatttgtaatagctgcaaaaggagagtttttcttagggctacatctccaagattatctcaactcccagtagaaccggtaacatggcaaaaagcatcggcttagaattttgactggaaacagttgtgcgtgtgttggaggacctagttcttgattcaggggaaagctggttctttacaaagttgaaaatcacagtggctcacacctgtaatccccaaactttgggaggccaaggcatgcagattgcttcaggtcaggagtttgagaccagcccaggcaacatggggaatccccatctttacaagaaatacaaaacttagctgagtgtgatggtgcgtgcctgtaatcctagctatgtggggtgggggctgtgatgggacgatgtctgagatgggagcctgggaggttgagtgagctgagattgcgccactgcgctccagcttgggtgacagaggaagaccctgtctcaaaaaaa

SEQ ID NO: 52914 - DNA, 758 bp, Homo sapiens
  misc_feature (617)..(617): n is a, c, g, or t
ctattcctcagagaggaccccagagaataattgattttgcaggaaaatgggtttgattttggttatctctctgagtggggaaaacaatctgatatttgtaatagctgcaaaaggagagtttttcttagggctacatctccaagattatctcaactcccagtagaaccggtaacatggcaaaaagcatcggcttagaattttgactggaaacagttgtgcgtgtgttggaggacctagttcttgattcaggggaaagctggttctttacaaagttgaaaatcacagtggctcacacctgtaatccccaaagtgctgggattacaggcttgagccactccgccctgcctgttaattacaattaatgccatgttctttcattcattaaaagatttttttttttttttgagacggagtcttgctctgtcgcccaggctggagcagtggtgcacagtcttggctcaccgcaagctccgcctcctgggttcacgccattctcctgcctcagcctcccgagtagctgggactgcaggcgcccgccacacacgcccggctaattcttttttggattttttagtagagacagagtttaccatgttagccagggtggtcttgatctnctgaccctgtgatcccgccttcttggcctcccaaatgctgggattgcaagcctgaagcactgtgccaggccgattaataagatttctttgtattaagttacttgacagttatataaaagtaatgttgaggttaggtgagct

SEQ ID NO: 52915 - DNA, 704 bp, Homo sapiens
  misc_feature (563)..(563): n is a, c, g, or t
ctattcctcagagaggaccccagagaataattgattttgcaggaaaatgggtttgattttggttatctctctgagtggggaaaacaatctgatatttgtaatagctgcaaaaggagagtttttcttagggctacatctccaagattatctcaactcccagtagaaccggtaacatggcaaaaagcatcggcttagaattttgactggaaacagttgtgcgtgtgttggaggacctagttcttgattcaggggaaagctggttctttacaaagttgaaaatcacagtggctcacacctgtaatccccaaagtgctgggattacaggcttgagccactccgccctgcctgttaattacaattaatgccatgttctttcattcattgcagtggtgcacagtcttggctcaccgcaagctccgcctcctgggttcacgccattctcctgcctcagcctcccgagtagctgggactgcaggcgcccgccacacacgcccggctaattcttttttggattttttagtagagacagagtttaccatgttagccagggtggtcttgatctnctgaccctgtgatcccgccttcttggcctcccaaatgctgggattgcaagcctgaagcactgtgccaggccgattaataagatttctttgtattaagttacttgacagttatataaaagtaatgttgaggttaggtgagct

SEQ ID NO: 52916 - DNA, 640 bp, Homo sapiens
gacaggagttccgggattgtccacagcacggactctgatacaactatccagtccgctgcagggaccggtcactgtgtcacaggttctccagagggccagaactaacaggatatatgtatatattgaaagggagtatattagggagaactggctgacaggatcatcaggcaaagtcccactatagtccatctgcaagctgaggaaggaagaagccagtcacgcctgtaatcccagcactttgggaggccaaggtgggtggatcacctgaggtcaagagttcgagaccagcccaaccaatatagtcaaaccccatctctactgaaattattaaaattagctgggcgtggtggtgggcacctgtaatgccagctactcgggaggctgaggcaggagaatcgctggaacccaggaggcagaggttacagtgatccgggatcgcgccactgcactccagcagcctgggcgacagagggagactccatctcaagaaaaaaaaaaaaaaaaaaaaaaaaaaaaaaaaaaaccgcgggggccacctatatgccggggggcggaaaagggggtacgagaaggggccaggggcaaaagtgtgttcccgggcaccggttttctggcccagggggaaaccgcgggccccttg

SEQ ID NO: 52917 - DNA, 679 bp, Homo sapiens
ggactacaggcgtgcgccaccacgcccagctaatttttgtatttttagtagaaacggggtttcaccatgttggccaggatgatctcgatctcttgacctcgtgatccacctgccttggccttccaaagtgctgggattacaggtgtgagcccccgcgcccggccagtggtgtcttgttttaacggacggttccctaatgacatacggtgaacatcttttcctgtgtttatttgccatctgtattagggttctccagagggccagaactaacaggatatatgtatatattgaaagggagtatattagggagaactggctgacaggatcatcaggcaaagtcccactatagtccatctgcaagctgaggaaggaagaagccagtcacgtctcaaagtccaaaagcctcaaaagtagggaagccaacggcgcagccttcagtctgtggcggaaggcctaagagtccccgacaaaccactggtggaagttcaagagtccaaaggccaaagaacctggagtctaatctccaaagacaggaagtatccagcacaggagaaagatgaaagccagaagactcagcaagccagcccctcccaccttctgcgctgactggatggtgcccacccacactgagagtgggtctccctctccccgtccactcactcaagtgtcagcctccctg

SEQ ID NO: 52918 - DNA, 302 bp, Homo sapiens
aaatgccaaatacattttaaaactcattcaggattagcgttcaccttaaacttgacagactctgagaacgggctggccacaggttgtgctgtgcacaacccttagtgctcatccgcgactaatatttggataattgattgttggaagctcaggaagcctctctctctctctccgagggattgaagttaacttccttatttctgaggtagggaagaaaatgaggatgccctgccttttgctagactgaatactgtcctccaaaaattcacattcaccagaaatcccagaatgtgaccttatta

SEQ ID NO: 52919 - DNA, 198 bp, Homo sapiens
tggatagcatgaggcaaattgccagaagagaatttctttcgcatcctagtagaataaatccaaattatctttgtggtactgaggatgtctggtttagcacagtgtaaagttgtaacactttaacaggctattaattcacagtcactaattcaatgcttgcccggagttttgctagaaaaggatgagaaggattaaggt

SEQ ID NO: 52920 - DNA, 640 bp, Homo sapiens
tcaggtgatccaccagcctcaggctcccaaagtgctgggattacaggtgtgagccatcgcatctggctataagcactttattataagagcattttataaaagaacaaagatacctgacattaattcttcccttagggaattattgagataatatgtaaaaatcatagcccataagtagtcatcaacttcttagccttttctatgtacttgataaactcactcagccattaaaaataattcctttggtggtggaggtggtactaagtaaggcggaagtgtgtaattctgaattagtcatgttagttaccgcccgataaatattagcggatgatttacacagtgaagacagtttaaatacagcaagttcagcatcactacgttgtttcaacatacatcatttacattataatcctgcagtgtgttttagtaattttcacttttcaatggtttctgctaattatactacaagagaaaaaaatttaaacccttgacaaacaggaaataatatttgtgaatatatttgtgttcccatctcagtatttttaatactgagataaatatactgagatttttaatatttttaatttttaatactgagataaaatatactagtattttctcgtttgaggtaataatttaa

SEQ ID NO: 52921 - DNA, 3468 bp, Homo sapiens
tcgtgcaggaggagggctgctaccatcagggacgtgcacgatttcccccaccccgccccctccccaaactccaaaaaaaaatccaaaacacactgccacccaccgtgcccccgcgccccgagcccctccggtcccggcctgcgtttgctagcgagcgcggggaacccacggcagtgtctgtgcctgtgccaggctgcaggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacctactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacgtcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatca

SEQ ID NO: 52922 - DNA, 3355 bp, Homo sapiens
agcggggggcaccagccagctccaggatgtgcggcggccgccagcggcgcggcgcggatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacctactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacgtcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatca

SEQ ID NO: 52923 - DNA, 3253 bp, Homo sapiens
agcggggggcaccagccagctccaggatgtgcggcggccgccagcggcgcggcgcggatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacctactttaaaaagcttttcaagaagcttgaggttgatagttcttcggtcatagaaatagattttcttcgttctgatatatttgaagaggtcctgaactacatgtacacagcaaagatttccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacgtcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatca

SEQ ID NO: 52924 - DNA, 2104 bp, Homo sapiens
tcgtgcaggaggagggctgctaccatcagggacgtgcacgatttcccccaccccgccccctccccaaactccaaaaaaaaatccaaaacacactgccacccaccgtgcccccgcgccccgagcccctccggtcccggcctgcgtttgctagcgagcgcggggaacccacggcagtgtctgtgcctgtgccaggctgcaggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacctactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagtcgagaaaaatcactttttctttcatcatacacacctctaaaaagaactggaattc

SEQ ID NO: 52925 - DNA, 2811 bp, Homo sapiens
tcgtgcaggaggagggctgctaccatcagggacgtgcacgatttcccccaccccgccccctccccaaactccaaaaaaaaatccaaaacacactgccacccaccgtgcccccgcgccccgagcccctccggtcccggcctgcgtttgctagcgagcgcggggaacccacggcagtgtctgtgcctgtgccaggctgcaggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacctactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacgtcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagacca

SEQ ID NO: 52926 - DNA, 2111 bp, Homo sapiens
  misc_feature (2087)..(2087): n is a, c, g, or t
tcgtgcaggaggagggctgctaccatcagggacgtgcacgatttcccccaccccgccccctccccaaactccaaaaaaaaatccaaaacacactgccacccaccgtgcccccgcgccccgagcccctccggtcccggcctgcgtttgctagcgagcgcggggaacccacggcagtgtctgtgcctgtgccaggctgcaggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacctactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagacncgcctaataaccgatatccagcgg

SEQ ID NO: 52927 - DNA, 1773 bp, Homo sapiens
agcggggggcaccagccagctccaggatgtgcggcggccgccagcggcgcggcgcggatatgggtctgcaggatggagttcttccggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacctactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaactaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatca

SEQ ID NO: 52928 - DNA, 445 bp, Homo sapiens
aatcattgatttagggaaaattgttaagaggctctttctgggcagcaaaacttatgacgcatttcataactgccttcctgagacgttccttctcctctctcaccgcagatctcatggcttctaatttcttggcctgttttctacttttctccaatgaagtatagtctccattaacttcctgagaatgagtagttaggagatctttgtcttcttcctttaaaatttttttttgaaatattcaactttgaattcattgccgcattgtttttcggtgtcagaaatgctctgaaaagtcaaatgccctactgatctctaggcctttgaaaggctttcttgatctggttttctttcttggaggctttaagatttgttctttatccttgatgttcaaaatttcacaattatgattttttatgtagctctgtttttgtttacttttcaatct

SEQ ID NO: 52929 - DNA, 514 bp, Homo sapiens
gggtaaagaaattaccaggaaagaaaaaatggaaatagtaatttgggaagatgggccaagactgggcatgaggtttctgggtacccagcatggctccagcaagagagggagcggggggtgctggagactgtggacagagcaatccggcctttgagtcagcaaagtcctgggtggggagggctagagagcctgatgtggctaaaaacaagcttctgccaacaggtgaaatgggcactaaaggagaaataaatttcagttattgaatatcaaaagggttccagttattgtccacacagatttgaggtccgaaatacaaaactcctacgtgatggtaacagttctttttagaacctccttctctccattactgccccagataaaactccccctagacatgagcttccagggccatggagagaaggcagtagggttgggaaggacgcaggttgtggaacattccatgaggatgttctttccatatttatttttactgcttggccttctagacccaaat

SEQ ID NO: 52930 - DNA, 448 bp, Homo sapiens
cttgctgctgactggttggggcagagacgaaatcatagggggttgatgctctcctcatgccagctgaatggcttcagggtggagccacaggagcggggttgtctctgcaggtggagtcatcggttccaggtggagccatgggtgtcagacatgcagaaaacctggaaaggtatctccaaagtccgatctacagcagtggtggtatttgcaggagtaactgggggaagttgcatatcttataacctccggaatacttgtctgcaccttagcaggacgcaggctcctctcctcccctcagcctgatggcctcctattagctttacaaaagcgattgagttttgggcaaggcctatcattgatacggctctgatgggtggagaacactaggttcttcgtcgcctccctgggcgtcgtttccaagactacctatagcgacgctttttcccac

SEQ ID NO: 52931 - DNA, 523 bp, Homo sapiens
gtggtctgcatcctcattcaggtaacacccccagcctttcatgctgagattggccattttatttgtaactcactgtacaatccatttgctcttccagtgtcccttagaaggatgcagagtgtactgtagaatgccatagagacctgggtttagggaaaatatttgacccaaagtccgccaactcacatgagtatctccccacaacttgtaccgtgctagtctctgggtatatagcaaatgaaaccgtgcctgaacagatgttacaaacaccctcccctgagagactccagggctgctttattcatgcaaaacggtgggctctaataagctcagagctgagaggaacaagttttcattccagcgttctcaaaaactccctttgtgactttaggcctaataataataacactacctaggtagtgaacacctctgtgccaagaaatatcatgatcattgcctgagttgtaattctcacagtagtcctgcaggacagctgctattactgcttattatgcagatgggc

SEQ ID NO: 52932 - DNA, 268 bp, Homo sapiens
gtgattaatattaactaagcacaacgattataatttgctaagttaaactgaattaaattgctttatatatctagaaccagaccggaaatatctgggtggttattatagctaaattccatactatagcaataagataaaatatgagttatttactgtctaatatggacatatacatggctctgtatatctatttttcttcatcaaatatcaaatgcaatattacacattagacacaacaattaacttgtgttcatgtttctgaaattga

SEQ ID NO: 52933 - DNA, 445 bp, Homo sapiens
taacagtttttataatgctgtggctctttaggtctcaaaaaacagaaactctctctctgaccttctcctattctcctgtcagcagcccgagacaggactctaatcttctttcaccattctgattgtgggttataagatcctcatttcagaaggggtcctggcccttagcctggaaaaaggaatacagcacagagaagccaaaaagaatctggacaagccttgctgggtttctgttcagcctattagtgttagagaataccctttttgtccaatcatacttctccctggtggtcaattctgtctatgcagtgaagtctccattaaaggcccaagaggacagggtgcaagagaacttctggatagctgaatatgtggaagctgagaggaaggtgaacaagaattcatctatgtgctgggaagtggtgcaccccaactccaaagggac

SEQ ID NO: 52934 - DNA, 448 bp, Homo sapiens
acctgcatggctagatcttccacttctgtccaatctttgcttaaaagtcatcttttttcaaagaagcctaccctaatcatctcatttaaaatattgccccttccccagaatcctcccttccttgcttctgtttttttcatagtacttaccttctaaccttctaacatcgtcattttctatttttattttctattgccttccctccgctagaatgtaagctccacaagatcggggattttttttttttcattttgttcaatgtttccttagtacctaaaatactagaatagtagatggcacagagtagatgctcaataaatatttcttaagtgaataaatgaatgggtgaatcattgcctaaaagacactaaaaggaaaagacctaattaaaactatttaaaaacaaaatccttggtgttgaaagattaaattatttaaaagttggcca

SEQ ID NO: 52935 - DNA, 1161 bp, Homo sapiens
cagtctttgcaaggcgacagctgtgccagccgggctctggcaggctcctggcagcatggcagtgaagcttgggaccctcctgctggcccttgccctgggcctggcccagccagcctctgcccgccggaagctgctggtgtttctgctggatggttttcgctcagactacatcagtgatgaggcgctggagtcattgcctggtttcaaagagattgtgagcaggggagtaaaagtggattacttgactccagacttccctagtctctcgtatcccaattattataccctaatgactggccgccattgtgaagtccatcagatgatcgggaactacatgtgggaccccaccaccaacaagtcctttgacattggcgtcaacaaagacagcctaatgcctctctggtggaatggatcagaacctctgtgggtcactctgaccaaggccaaaaggaaggtctacatgtactactggccaggctgtgaggttgagattctgggtgtcagacccacctactgcctagaatataaaaatgtcccaacggatatcaattttgccaatgcagtcagcgatgctcttgactccttcaagagtggccgggccgacctggcagccatataccatgagcgcattgacgtggaaggccaccactacgggcctgcatctccgcagaggaaagatgccctcaaggctgtagacactgtcctgaagtacatgaccaagtggatccaggagcggggcctgcaggaccgcctgaacgtcattattttctcggatcacggaatgaccgacattttctggatggacaaagtgattgagctgaataagtacatcagcctgaatgacctgcagcaagtgaaggaccgcgggcctgttgtgagcctttggccggcccctgggaaacactctgagatatataacaaactgagcacagtggaacacatgactgtctacgagaaagaagccatcccaagcaggttctattacaagaaaggaaagtttgtctctcctttgactttagtggctgatgaaggctggttcataactgaggtaattatgaaatatgtgccaatttattctctatgcaaattctataaaacagtccaaagttaaataatagttactcaagtttttatacataaaagattttttcacttaggcat

SEQ ID NO: 52936 - DNA, 337 bp, Homo sapiens
ctgttccctaaatattattaaaattttaaaaattagacatttggtctaaattagacaggtaagatactactgtccttactagatgctttaaagtcataaactgcttctatggcttttgataattgttcaacttgcttgctttagagccattggattctaggtaaggcctagagacatttggagttagccatatcccctagctatgctagaaagagtccgacattatctgtggttctgccctgtatcctacactctacacctgatacataattaaaattacttacactaaaaataaaaatcatgcatttttagtagaaaggtatggaaattatagttt

SEQ ID NO: 52937 - DNA, 322 bp, Homo sapiens
tgggattacaggtgtgagccactacacccagccatttttgcttgtttatacgtggctgctagaaattttaaaattacacatgtggcttgcctctgtggctctcattatatgcctgtgggacaatgaagctctagaatctacatgatatctctgtagacaggatgactggtagatcgtgggtgctggagggtggtagctcaaagatttatccaaaaagtcaatcgagaactgcaatgaaagcatgttacagagaacttggcccatagcagaggctcaggaaatacttggggatgaagccacacacagcaaatatttctacatg

SEQ ID NO: 52938 - DNA, 192 bp, Homo sapiens
ccaagtcctctcgctccacacttgctctctgagtcatctcatctacaatcacatcttctatcagtgcaccgaggagtcagtatttctgacatgaatctgtccctcgagccccagacccatagatacaaactcctaatggacgtgtccgtgtggatgcaccacaaacacccaaacatgccccaaatggccttt

SEQ ID NO: 52939 - DNA, 319 bp, Homo sapiens
  misc_feature (206)..(206): n is a, c, g, or t
  misc_feature (237)..(237): n is a, c, g, or t
  misc_feature (271)..(271): n is a, c, g, or t
ctgctagcacgttttcacctctcaatacaagaagctacttcatagaagaagcaaacttagaatacatttaagtttgcgttcaaactcttcacttcccaataccagtgggaaaatgaccacaaaaacacctttgaagactatatttattattggtgaagattggaggaaataaacttttcatatatcgactactgtaggaaggcctnagacaaaacaatgttgaaattaggccaactnagagccctataatggcatctaagtgtttcagtgnaaggtaggaatcacatctctcactttaaatcaaaagctaggtatcatt

SEQ ID NO: 52940 - DNA, 2224 bp, Homo sapiens
ctgcccctcgcctcccgcacggagctcgctcggggaacgcccccatccactgccctccacagcctcagggacaagggtgaggccaggggagcagagggagcagtcatggcggagctggaggctgtggccgacgatctagacgccctcatcgacgacctggactacctcccgggccactttcacctggagatgcagttgaacttcgagccgcgctcgccggccccacagcgcgcccgggacctgaagctgcagcgggagggtctgcggcaggagctccagctggcggccgccccgcagcgccccgctgtgcgtcacctcctgggcgctttcgcattctacctggaggagctggacgaggcccgcgagtgcttcctcgaggtggcccacgagcacccgggcaacctcaatgcctgggccaatctggcacacgtgtacgggcggctgggccaggaagaagaggaggaggcgtgcgccgcacggctggccgacctcatgggcctggcagaggagcccgaggccgccggggacccccagctccgcgccgctcgctgcctggccgagcagggctacgcgcatggcttcgacgtcggctgcgccagcccagaggagcgtgcgcgggggctggcggcaggcatcgcgctctacgacaaggcgctaggctacgggcagcagatcccgatggaggagaaaaggggctggtatttcaccatggcaacactctacatcaggctagatggcatcttcctggagctgggcagtgaggagcagaagagactgcctgccttcaaccgcacgctggccctactccggcaagtgctgaagtccgaggacccccgccaccgagccctggcctggtgctacctcgggatgctgctggagcggaaggacaccttctccaccacccccatgggcgtccatgactgcgggtactcagggaccgaccctctagactgcttcggcaaggccattgagattgccaagaaccaacctcccatcctgaatcgcctggcaaaaatcttctacttcctgggaaagcaggatatggccattggaacctgcaacatggccctggatgtcctacgagatccagagctcaactggcaggcgtactgcacaagggccaagagacgaggtctcactatgttgcccagactcgtctcaaactcctgggctcaagcagtcctcccacctcgacctcccaaagtgctggaattccaggtgtgagccactacacccagccctgtaaggtttttgagtgaaagaatgcaggagcctccactcactgcaggaatcccttctacaattcctgctcagtgagcccccagcctcttctggattggcacgggtggaatcagactgaccagagttgaaatctggcttctccgccttgtggaacttgcagcaagccacttacccccacaaacttcagttcccaaatctgtaagatataaataacaacactttccttaaaatgttgtcaacagacacagtgaggtagcatctaaagcacagtgccttggacatagggggtgcttttctgaaagccagtagagggtcatttaatatagtggatcagagctctggctctgaacacagacagccttggttcaaatcccacaacaccacgtgctacgggacctttggcaaaatactcttgcccagattctgagcctcaatttctttatctgtagactggagttgttatgagaattacattagattttgtacgtaaaactcagcatcaagcacacagtaagatttcataagagactgactgctactaatttaatattaggcatatttttgaattatctcactgtctcttgatgcagtccactgcatagtcattcagctctgcaagttacacacttaggtgagttctgcctcctgctagcttcccgcactggtcccagacctgcctcctagagcccacacagagcccatgtgcttgaggaagccgactcggagctcccagtttacttcactgcaagccgaagagtcctcccatcccctcatcttctccactactatccacatgacctagtggcaaatctactcccagtcttggtctcagtggcttaattactttgccagcaggtacgaggcaggagtgaaattccttcactgtcgtggatgtggttattattctagataataatgacattaaccataatagtaaataataaaatatctctataaaattctgcatttcatcagcactttc

SEQ ID NO: 52941 - DNA, 2352 bp, Homo sapiens
ggtggcctggcacccagccagcagggtaagggcagaggtggctgggcccttcctactggaaagggctccccaaaccgccaccccccaccaccacgggcctgggcagggctggcagcacacaggacagccgggaggggtgccacccaaccacatctccttctcggccacaggctagatggcatcttcctggagctgggcagtgaggagcagaagagactgcctgccttcaaccgcacgctggccctactccggcaagtgctgaagtccgaggacccccgccaccgaggtggggacccgggggatgggtgggacagcagcctctgccccctgccaacagcccgctggcattgcatccacctctggcattacctccccttcttggctcctgtttcttcctccttcgctctgtcccctacactcatctgtgcacctcaaggagcccacataccttgcccaagtgaacatgccaactacaagtcactgtgactgcaggcttgcccgtctgcagctcatgacctggagggtgagaggtagtttcccctatttccacctatttatggtcagaagattgaagcctctgttggagaggagtcgagtcatttttttgcagggccagacagcaagagcagggactagaaccaccagagctggtgagagctgaagtcagaagagacctacgtacctgaaatgaggtcccccgatgacacattgagcacagaataagcactaaaatgggttcactaacccctcacatggcccctctctccacctttgcttctctctgtccctgtgttgccctcagtgatcccactctactatcccttgctttgtcttcatgggtgacacctaggatggggatggccccttccctctctccaccctgctgcttcctagagaccctctcccacccttcacccccagccctggcctggtgctacctcgggatgctgctggagcggaaggacaccttctccaccacccccatgggcgtccatgactgcgggtactcagggaccgaccctctagactgcttcggcaaggtacttgcccccagccacacccaccctctaaactgagaaggagcctggcaccccagcctctccacctagaacccaggcttctctgggtatcaacccccaccgcgtggcccacccaggaagtacacttactccagaccttgctctccatcctctcttcattcaaaacaaaagagaccctccccatacccagtctggccccagcccatttctccagccttgaaatagacccttagactttttcccttgagaccttcattcacagtattccctctgccaggagttccctacctctccacccccagtggcatagtagaaagatgggtttagctggtgtctccttgccagccctgcccataggctgtgtgaccctaaggcaagtcacttacaacaggaagcagtcaatgacaatagtgggggtaagtgttattacccaggtagaaaccctgtactttgtaaggttgggggatgggggttgcctctggcccttcctctcacctgccctaggaagatgggagagcatacactgggaaggaggggtctgactgggctctggaaggctttactggatgtgaccggtgatgtggtcgtgggccaggctctcaggagttgagtgccaataggttgtgccccaaggtgttggggcttcgtgatgtgacaacttactggcaggtggataagggtggatatgggtaaagggcaccatgttgatacggctgtatccaaagatggggttcctgtggttcagcactgtttagccagctctggctaatgaccaagcaagtggtttgtttttgcactcctcccttacctaggccattgagattgccaagaaccaacctcccatcctgaatcgcctggcaaaaatcttctacttcctgggaaagcaggatatggccattggaacctgcaacatggccctggatgtcctacgagatccagagctcaactggcaggcgtactgcacaagggccaagatccacatcagagcctacctgcatgacctcaagcgggccaagatgggtctcgggggcatgcctgacaggaaccacctggcctgtgccaaggctgaccttgaggaagtggtcagggtgtgcccaggcttcaaggcgtacctggacatcggccaggtctactactatatgggcgtggacgcggtgcaggagctgctggcggtggacgaggcggcgctgaaccaggcgctggtgttcctggccaaggcgggcgagtcggagctgggtgccacgctgcccgagctgcagctgctgcgcggcaagtgcctgcgcatcaagggcgaggacgccaacgcggccgc

SEQ ID NO: 52942 - DNA, 1463 bp, Homo sapiens
ctgcccctcgcctcccgcacggagctcgctcggggaacgcccccatccactgccctccacagcctcagggacaagggtgaggccaggggagcagagggagcagtcatggcggagctggaggctgtggccgacgatctagacgccctcatcgacgacctggactacctcccgggccactttcacctggagatgcagttgaacttcgagccgcgctcgccggccccacagcgcgcccgggacctgaagctgcagcgggagggtctgcggcaggagctccagctggcggccgccccgcagcgccccgctgtgcgtcacctcctgggcgctttcgcattctacctggaggagctggacgaggcccgcgagtgcttcctcgaggtggcccacgagcacccgggcaacctcaatgcctgggccaatctggcacacgtgtacgggcggctgggccaggaagaagaggaggaggcgtgcgccgcacggctggccgacctcatgggcctggcagaggagcccgaggccgccggggacccccagctccgcgccgctcgctgcctggccgagcagggctacgcgcatggcttcgacgtcggctgcgccagcccagaggagcgtgcgcgggggctggcggcaggcatcgcgctctacgacaaggcgctaggctacgggcagcagatcccgatggaggagaaaaggggctggtatttcaccatggcaacactctacatcaggctagatggcatcttcctggagctgggcagtgaggagcagaagagactgcctgccttcaaccgcacgctggccctactccggcaagtgctgaagtccgaggacccccgccaccgagccctggcctggtgctacctcgggatgctgctggagcggaaggacaccttctccaccacccccatgggcgtccatgactgcgggtactcagggaccgaccctctagactgcttcggcaaggccattgagattgccaagaaccaacctcccatcctgaatcgcctggcaaaaatcttctacttcctgggaaagcaggatatggccattggaacctgcaacatggccctggatgtcctacgagatccagagctcaactggcaggcgtactgcacaagggccaagatccacatcagagcctacctgcatgacctcaagcgggccaagatgggtctcgggggcatgcctgacaggaaccacctggcctgtgccaaggctgaccttgaggaagtggtcagggtgtgcccaggcttcaaggcgtacctggacatcggccaggtctactactatatgggcgtggacgcggtgcaggagctgctggcggtggacgaggcggcgctgaaccaggcgctggtgttcctggccaaggcgggcgagtcggagctgggtgccacgctgcccgagctgcagctgctgcgcggcaagtgcctgcgcatcaagggcgaggacgccaacgcggccgc

SEQ ID NO: 52943 - DNA, 1455 bp, Homo sapiens
ctgcccctcgcctcccgcacggagctcgctcggggaacgcccccatccactgccctccacagcctcagggacaagggtgaggccaggggagcagagggagcagtcatggcggagctggaggctgtggccgacgatctagacgccctcatcgacgacctggactacctcccgggccactttcacctggagatgcagttgaacttcgagccgcgctcgccggccccacagcgcgcccgggacctgaagctgcagcgggagggtctgcggcaggagctccagctggcggccgccccgcagcgccccgctgtgcgtcacctcctgggcgctttcgcattctacctggaggagctggacgaggcccgcgagtgcttcctcgaggtggcccacgagcacccgggcaacctcaatgcctgggccaatctggcacacgtgtacgggcggctgggccaggaagaagaggaggaggcgtgcgccgcacggctggccgacctcatgggcctggcagaggagcccgaggccgccggggacccccagctccgcgccgctcgctgcctggccgagcagggctacgcgcatggcttcgacgtcggctgcgccagcccagaggagcgtgcgcgggggctggcggcaggcatcgcgctctacgacaaggcgctaggctacgggcagcagatcccgatggaggagaaaaggggctggtatttcaccatggcaacactctacatcaggctagatggcatcttcctggagctgggcagtgaggagcagaagagactgcctgccttcaaccgcacgctggccctactccggcaagtgctgaagtccgaggacccccgccaccgagccctggcctggtgctacctcgggatgctgctggagcggaaggacaccttctccaccacccccatgggcgtccatgactgcgggtactcagggaccgaccctctagactgcttcggcaaggccattgagattgccaagaaccaacctcccatcctgaatcgcctggcaaaaatcttctacttcctgggaaagcaggatatggccattggaacctgcaacatggccctggatgtcctacgagatccagagctcaactggcaggcgtactgcacaagggccaagcttcccgcactggtcccagacctgcctcctagagcccacacagagcccatgtgcttgaggaagccgactcggagctcccagtttacttcactgcaagccgaagagtcctcccatcccctcatcttctccactactatccacatgacctagtggcaaatctactcccagtcttggtctcagtggcttaattactttgccagcaggtacgaggcaggagtgaaattccttcactgtcgtggatgtggttattattctagataataatgacattaaccataatagtaaataataaaatatctctataaaattctgcatttcatcagcactttc

SEQ ID NO: 52944 - DNA, 330 bp, Homo sapiens
cgcatcaggaagaataaagagaaagagacagagaatgcaggcggtagagccaaatgacctctcaaatgtcttctggctctgtcacctccccaaagttggagtccatgatttcataaatggaaaaacacaaacactttcttcagtaaaaatttagctgacggccaggcgcagtggctcacgcctgtaatcctagcactttgggaggctaaggcaggtgggtcacctgaggtcgggagttcgagaccagcctgaccaacatggtaaaacctcatctttactaaaagtacaaaattagccaggcgtggtggcgcatgcctgtaatcccagcta

SEQ ID NO: 52945 - DNA, 970 bp, Homo sapiens
ttcctcgtggtcgcgcacccgtttcacctcaacaacaaagcgcggtttcctccctcgccatccttcctcatggtcgcgcacccggcttacctcaccaacaaagcgcggtttcctccctcgccatccttcctcatggtcgtgcacccggttggatttcacagtcatggaagttctgctttaaaatccgtttctgaagaagtgttaatgatcttgacactgctgaccagggacaaaatgtcccattgacagtcatgctctggagcaggatgggcagtgagagaccagagaccacaggatgggtaagaaatagcccagctcaggctactgggttgaagaactgccagagcgtgatcgccaacgtgcagatttctgatctacgtgtaatgtagaagctgactgttctgtatctgacgtttcatttagagtctatgaagtagcttaggccaattactcatagccgcctgcccctcctcagttacctggacatatgtcttgtgttctggaatcaaaactaattctgaatgcatatcctgaaaacatgggacacttactcagatttcactcttgggtgtcattggccttttaattattttctatcaatagaccgaccttagatttacttgtcaaaaaaagtaaggtcattttatgagcactttcattccaatttcctagatgtcttttctgattagaaaaacctataaactatgtagctttgaatttatagaatcattattcctgaaggttttgctgtcctttgcgctcagagatggtcccactgactcagagatggtcccactgacccagcatggcagagcctgtgattgcagctccaggggccctcaattcatttgtttccctgcctctccatctccccatgttatcctgtcaccccaaaaagcacctgcctgcaacacggtcaacagagtccatccatagagtcccgctggttcagctggttgtttccagcttt

SEQ ID NO: 52946 - DNA, 340 bp, Homo sapiens
ttcctcgtggtcgcgcacccgtttcacctcaacaacaaagcgcggtttcctccctcgccatccttcctcatggtcgcgcacccggcttacctcaccaacaaagcgcggtttcctccctcgccatccttcctcatggtcgtgcacccggttggatttcacagtcatggaagttctgctttaaaatccgtttctgaagaagtgttaatggcagcagtgagcccccctgcctctgattgtcatctttgggggccagagaagtgagcagctatccttcccagtccctggtccctccaagcagtgacaacaaagaatggaccaggcgaggcattgtgtgtagaca

SEQ ID NO: 52947 - DNA, 914 bp, Homo sapiens
gtttcaagaaacattgctgagggtagcagtgaagttggatgtttgctaggaaattatgaaaacaaatgtgactcagagaggtcatttcacattttatctttatatcctctctttactaaacctgtgtttggataagttggtcaatcatccaaggatcctctatgttttctttacagttgacactgggtcaattttctaaggaaaacaccttgacaaataaagcatcttcattagaggtcaggaggaaaaataactattctctttcaaaagaaaatctgaacaatttttttagcatggcccaatgttctatttcctatatttagaaactttgaataagggtctagtaatcttgtctcagaggcatagaaacaaaagtacagttattaggtttaactatactcaaactatttgctatttttaaacatttttgctgtaagtttatatatatatacatatataatacatatatacatatatataatatatatatacatatatatataattttctttgttaaaaataacaattgaaaaagactggcatgagacatgaatggctgagtcatttaattgccatacaaataaaatgctgacaggtttcaagcaaaaaatacagtatgcaccttaaataatgcctcagaattgtataatttaagctcactaaaaaccttacttagtcttaaaattctccttaggggagccttttcagcagttatggacatcaaagaaaaaagtatcttgtaaaagcacaatgaaatttagaaaatacacattttagtggcaatcacaaatgtcaatataaaagatacataaaatatgttaatgcaagaactttttcatattcattgaaaactataactttgtgctatttataaagtagatattttccaggtatgaaaatataatttggaaacc

SEQ ID NO: 52948 - DNA, 563 bp, Homo sapiens
gctgggtgacagagcaagactctgtctcaaaaaaaaaaggaaaaaaaaaagttttatgaataagtaatttaagtagacctatattcaataaagaaatagaatcaataattattagtaaccttccaaaacagaaagccccaggcccagatgggttggcgagtgaattccaacaaatatttaaggaagaaatgataaaaattctcaacaatctttcagagaatagaagcagagggactacttgctaactagctctatgagaccaacattacactaataccaaagcaagacaaattataagagaaaactacagaccaatatcttttatgaacacagatgcaaaaatcctcaacaaaatattagcaaatcaaatccaacaatgttcaaaaagaattacacatcgtgaccaagtaggatttctcccaggtatgcaaggtcaattctacatttgaaaatcaattaaatccattaatgcaattcaccacatcagtaggctaaagaagagaaatcacatgatcccttcaatagaggccaaaaaagcatttaatacccattcatgatttaaa

SEQ ID NO: 52949 - DNA, 859 bp, Homo sapiens
agtccccgtcctcactctcctctctgccactctccacagcttctgcagatggcctcccctctctgcgactggttccttatcgaggcaatggagatgtggactgcggtgactgatcaagcctcacatatctactgaatcaggaagcccgaagcctgaggctcccgagtggccccatgggagcgtcgtgcatttttctggtcagtcagtcattaggggaaacgatgaatgagccaggccagcatgagaaggcctgcatgctatcggatctttttcctgaaaacatcgacatgggacatgttcaaaccaaattttctttataagttataagaaaatcaggcggaggctaaactttttttttttttttggcaatgctgttgagaatattacattatgttcccacaatagcataaatgtatgtcttatcacttgaatggagcccagacaataaaagggcgcctgagagtggaaatacgcctatgagaaaggccaagccagcctttcgtgataacagcagcagggagggaagagtgcacagagctgaccacagcacaaatgtcgcagacccttgaggaccgcgccagggctcagagctccacccaagggcttgtgatcctcaccccagccaagttccttcagaccccagggtcttcgtttcgtgacttataaaatgggaattatatgtcatgggagtgttggggggaaaatgcaaccattagcaaatgctttcaaatataatatgtattatcaatatcaggtaaaggtaacattttatttcctagggccgggaatttgatttttgttttcccgtttatttttatccatgttcaaccacccacaagtgtgctctctcaaaacgcaa

SEQ ID NO: 52950 - DNA, 303 bp, Homo sapiens
caacatgtcagctttatagttgccgattagtgatatgggtctgatttcgatctcttcctgatgtaaaccatgctcacccatatcccactatacaaatgcaaatggttgcctggttccatttatgcaagggagccagtactgaattatgccttggcagaggggagactccaaaagagtcatcgcaggaagaagttaagaacactgaacatcagaacagtctgccaagaaggacattggcatcctgggaaagtccgccttttcccttgaccactatagggtgtataaatcgtgtttgcaaaatgt

SEQ ID NO: 52951 - DNA, 751 bp, Homo sapiens
attgacaaggaaaggccatgttatgttcaccctgggttaagttttaagtgtatcttatttaatttttttcaatatgagtcatctccagatactgtgatgatttccaaataaccagaatctagatgactagaaatttactctagctggctttagacaggaagcgtgaggacagaatccagctgcttccactccagggtaggtctgaagccaaccgtcctcggtttcctggcctgtggcatcagtctggttggattacacacaaagccctgcagatctgctgcttttcctgattctcctgtcctgagtgagtgcaaggggctcccctgtcgtcgatgtgttctttgaagcagatgctgtgcctgatacctgctggagagtcccaccgccttgagcttctgggtcgagaaaggccaagttgcacactactgagagactgccatgcaccccctggaggcctcagaacattcgacatgcttcagtcatggccacggcagtgactgctgattgcctaaccccacatgtgttctcccccttccctgataatcaagcccctgattttcagctgggcacaaaataattcttcctagaacaactccatgtgtgttatcgcccttgcagctgggggtggccaccactggggagaggcagggtgaagaggtggaaggagcctgagttagcagggatgagcagtggccaggtaaccccagacccactatcctctggatttcttttatgtgaaacaataaaatgt

SEQ ID NO: 52952 - DNA, 829 bp, Homo sapiens
agatattatagagaaatcttaaatgtatgagtaaccttttctgaaaaacaaaagtgggatgaaatatattggtaaaagtatccacttatcttgattattttcattttacaacatacctctgtgtacctttgtgttttattttgcaatctataaagaacttgtccataatcacacagttatcttttcaatattgagatactgtgttttttaaaaatcagtagaggtattttacttaagcattggccaagaagaatgtttaccacatatacagtttatattctttcatgctacaatatttataatcggccgagcacagtggctcacaccaggaatcccagcattttgggagaccgaggcccaggagttcaagtgtatacatatatgtatgcaggtgtggtggcacacaagcgtgtagtcccaagtagctggaactataggcgtgcgccaccacgcccagctaattttgtatttaaccctttcttaaactgtgaatacatgtgcactcaccatcctattttgtatacatagaaagcatggtaaaaatattgaatatttcttttacacaagtgatttgctgtatgttgagcagctctctgggaggtcagattatttacccacaggaagtggattgagtaggaataagtttacttcacagatatactaactactctttttcaccctataacatgttttgttttcttctcaacctatcaagcagatcttttcatgcttttccatggaagagccagtaatggtagtgaagaatcacaaatttccctggatctcttgcctgaagcagttcttcataaagactcttgtttcgtaccga

SEQ ID NO: 52953 - DNA, 335 bp, Homo sapiens
caaatgcatatatgtacacatgcatatgtctaatttttcattttgtaattaatttttagaccacactaaagttgctcttagtgatgatagggcttgtttctttgtttcattgtggctacttcttagcaccttctttagaaagcagttaggagaagatcatttgaaggccaacgagtgttgtgggttattgttaagctgatttaacattatctccccccacaaccacgcttgactagcttcacatttggccaggtgcagtggctcacgtctgtaatccagcactttgggaggctgaggtggaagatcacaaggtcaagagattgagaccatcctgg

SEQ ID NO: 52954 - DNA, 351 bp, Homo sapiens
agaagaataagtgaaggtacatgccccttgcacctgagcacgtggacttagatttccactgccctcattactcttccatgtttatgagttttagggccacataacttgtctttagaatgccctctcccaccctttcaggcaaagccccccatgttttctccctgataccctctctgactttccttggaaaaactcattatccctcctccacatgccccttagagaactgccctagtcctccagacagctataaatgaagcttacataaatggctaggaagaggagcatgagtgtataaatgcctacatatacataagtttgcatgtatggccgctgtattagtccattttc

SEQ ID NO: 52955 - DNA, 747 bp, Homo sapiens
cttcgacgccaccattttaaagggatttactgcacggacttctcccaagttcctaggcattatcttctggaccctatcctgcagaggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggaatcatcacattccacttctaaaaggagctttaaagatggcctggttgaacgtccttcctttgtgagtgaggaaattaagtgcagattaagtgacttgccaaagatcagatagtccaatggtggcagtgccaggaacagaattcagctttcttgcccctagacagtgtctttcacttgacccttactgagttttgaaccttagaattactaagattgttgttgttgttgtttaataaagaataaagctttgaaaaatttgttaatactttacattgtgtgggaaaaaagaaccaaatcattcaacaaaaatatcactcctcttggaaatgaaatttgcataaaagcacctattcct

SEQ ID NO: 52956 - DNA, 694 bp, Homo sapiens
ttatctgaagccggtttggaacttttgggagtttagttaccattatgattttaacaaatgatttttgatgaggcgatgtctcgaatgcactgggcctcgggaccctctggaccctgctgagggcgggtggaggagggacgggcaggctgtgggaagcgtgatggtgagatgtcccgtgttctctctcccccgccccctgcagatcgctgccgttttgcccttgggagtaggatgtggtgaaaggatggggcttctcccttacggggctcacaatggccagagaagattccgtgaagtgtctgcgctgcctgctctacgccctcaatctgctcttttggaatcatcacattccacttctaaaaggagctttaaagatggcctggttgaacgtccttcctttgtgagtgaggaaattaagtgcagattaagtgacttgccaaagatcagatagtccaatggtggcagtgccaggaacagaattcagctttcttgcccctagacagtgtctttcacttgacccttactgagttttgaaccttagaattactaagattgttgttgttgttgtttaataaagaataaagctttgaaaaatttgttaatactttacattgtgtgggaaaaaagaaccaaatcattcaacaaaaatatcactcctcttggaaatgaaatttgcataaaagcacctattcct

SEQ ID NO: 52957 - DNA, 2568 bp, Homo sapiens
agctggccctggctgccgccgctgcctcgtccggactcggagaggacttgggagggacagcggcgctgggaggtggcttagcagagactttccagcaactgctgcccaggacttttttttttttttttctttttcccaggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagcctgggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttattggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacagatgtcatacccactgtgtagcctgtgtatgacttttactgaacacagttatgttttgaggcagcatggtttgattagcatttccgcatccatgcaaacgagtcacatatggtgggactggagccatagtaaaggttgatttacttctaccaactagtatataaagtactaattaaatgctaacataggaagttagaaaatactaataacttttattactcagcgatctattcttctgatgctaaataaattatatatcagaaaactttcaatattggtgactacctaaatgtgatttttgctggttactaaaatattcttaccacttaaaagagcaagctaacacattgtcttaagctgatcagggattttttgtatataagtctgtgttaaatctgtataattcagtcgatttcagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaattacacagattattaaatttttttacaagagtatagtatatttatttgaaatgggaaaagtgcattttactgtattttgtgtattttgtttatttctcagaatatggaaagaaaattaaaatgtgtcaataaatattttctagagagtaa

SEQ ID NO: 52958 - DNA, 2515 bp, Homo sapiens
cttcgacgccaccattttaaagggatttactgcacggacttctcccaagttcctaggcattatcttctggaccctatcctgcagaggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagcctgggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttattggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacagatgtcatacccactgtgtagcctgtgtatgacttttactgaacacagttatgttttgaggcagcatggtttgattagcatttccgcatccatgcaaacgagtcacatatggtgggactggagccatagtaaaggttgatttacttctaccaactagtatataaagtactaattaaatgctaacataggaagttagaaaatactaataacttttattactcagcgatctattcttctgatgctaaataaattatatatcagaaaactttcaatattggtgactacctaaatgtgatttttgctggttactaaaatattcttaccacttaaaagagcaagctaacacattgtcttaagctgatcagggattttttgtatataagtctgtgttaaatctgtataattcagtcgatttcagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaattacacagattattaaatttttttacaagagtatagtatatttatttgaaatgggaaaagtgcattttactgtattttgtgtattttgtttatttctcagaatatggaaagaaaattaaaatgtgtcaataaatattttctagagagtaa

SEQ ID NO: 52959 - DNA, 1657 bp, Homo sapiens
  misc_feature (67)..(68): n is a, c, g, or t
ttccttcgcacgtaacagttttactttataaagaggagagaagctatctgcagagactctcttaatnntccccgctcagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagcctgggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttattggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacagatgtcatacccactgtgtagcctgtgtatgacttttactgaacacagttatgttttgaggcagcatggtttgattagcatttccgcatccatgcaaacgagtcacatatggtgggactggagccatagtaaaggttgatttacttctaccaactagtatataaagtactaattaaatgctaacataggaagttagaaaatactaataacttttattactcagcgatctattcttctgatgctaaataaattatatatcagaaaactttcaatattggtgactacctaaatgtgatttttgctggttactaaaatattcttaccacttaaaagagcaagctaacacattgtcttaagctgatcagggattttttgtatataagtctgtgttaaatctgtataattcagtcgatttcagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaattacacagattattaaatttttttacaagagtatagtatatttatttgaaatgggaaaagtgcattttactgtattttgtgtattttgtttatttctcagaatatggaaagaaaattaaaatgtgtcaataaatattttctagagagtaa

SEQ ID NO: 52960 - DNA, 2621 bp, Homo sapiens
agctggccctggctgccgccgctgcctcgtccggactcggagaggacttgggagggacagcggcgctgggaggtggcttagcagagactttccagcaactgctgcccaggacttttttttttttttttctttttcccaggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagcctgggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttattggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacagatgtcatacccactgtgtagcctgtgtatgacttttactgaacacagttatgttttgaggcagcatggtttgattagcatttccgcatccatgcaaacgagtcacatatggtgggactggagccatagtaaaggttgatttacttctaccaactagtatataaagtactaattaaatgctaacataggaagttagaaaatactaataacttttattactcagcgatctattcttctgatgctaaataaattatatatcagaaaactttcaatattggtgactacctaaatgtgatttttgctggttactaaaatattcttaccacttaaaagagcaagctaacacattgtcttaagctgatcagggattttttgtatataagtctgtgttaaatctgtataattcagtcgatttcagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaattacacagattattaaatttttttacaagagtatagtatatttatttgaaatgggaaaagtgcattttactgtattttgtgtattttgtttatttctcagaatatggaaagaaaattaaaatgtgtcaataaatattttctagagagtaaaaaaaaagagagaaaagaaaaattttgagagacggcccagcaattttgaaagg

SEQ ID NO: 52961 - DNA, 429 bp, Homo sapiens
tgtgaggtaataaaaagcaagttgcagaaatacatatattacatgctctcttttgtgtagaaaagcagggaagataagccaaaaactaacgacaatgaatgtggttaccaagaaggggatgaagtaaatgaggcagatgagacaggaatggaagtgctctcaacagatcttgttattgagttttatgtaaatattctgtatattccaaaggataaacatttttttaaagtagagcaatcccaaaaacttgaagtagaatataacaaataaacctggctgggtcaaattagtaacataatgttagtaacataacattgagaaaagaattatatcaagtgattttacccagcattttgactatacattcttagtgaaatacattccaagggcaatagaatatattccaagggcaaaaaaatactttaagga

SEQ ID NO: 52962 - DNA, 279 bp, Homo sapiens
ggattgtcccattttacagatgggaaactatgggttgtctgtttgtctccaggtctactttgcctactaatgacataagtcacttgttctgttgccctgtccttgatctctcattcattcattcattcattcattctgtgctagattctccccctagagaagaagcgacagtttcataaatgcagatagacccaactagagaggtgactatacaacagtagccatatagatttaatttcattttcaaagcagaagtgattgtgtagagatcttgtttgt

SEQ ID NO: 52963 - DNA, 334 bp, Homo sapiens
cagaagttagccaccaggaagacaatgaacagaaacacagagggaaatagaaactgacccatgaaagagagagatagagctgtagttccagttcgcagtccataagtttctttaccccccattattttagactgagtttttgttttttggaacttatactatattaatagcatatgaattaaacatcttgatcaatcagagcaaacaatccaaaaacttctgtaaaataaatatcaatagtttctaaattttaggaaagtgatattgggtaaatggaaggattaattttgtagtctggagatggggaaggcagaaaaccatgtttgcttctgta

SEQ ID NO: 52964 - DNA, 233 bp, Homo sapiens
actgttacctgagggctgttcctagcttctagaggctacccaccttccttggcttgtggccccctgcctccatcttcagtgccgtcaacagctggttaagtccctttcttgcttcagatatctcctgccacttcttccttcatggaatccctctgacccccccttctagcttcctcctccatgtttgaaaggcacacatgattatgttgtatccacctagataattgataaca

SEQ ID NO: 52965 - DNA, 2754 bp, Homo sapiens
cctgccgcctccgcggcccagtcggcaccggcgaggccgtgctggaacccgggcctcagccgcagccgcagcggggccgacatgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccgggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatggtc

SEQ ID NO: 52966 - DNA, 2011 bp, Homo sapiens
catggaagtgagaaccaaaagctggggcagggagcaccctggagggatagccggggagcaggtagagggccaaaacctggagtgggggcaggaggtgctccagcagcaactcccccagaggtgggtcccaacctccacgtcggccaattccaggtggccccaccgggtttcccccacccctttgtcccgcggagcccctcccttcatgagtgctgagcccaagggccaggctgtccccaggggcggagagttgcgggcccttcccgatccggtaatgggcctgggagatgccagattagcgtggtgcctgtccggagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgc

SEQ ID NO: 52967 - DNA, 2955 bp, Homo sapiens
caggcttaggctctctttcggcctcccactcgccttcctttcccttctcggtgccctcctctctttcctcacccggtagtcccagacaggggctgagggccgggcagcggaggtaaggggaaggctggagataggagggggactgggtgtgtccagccagagggatgtctgtggacagtgcagctgggggctttatggatctttgggtgtgtaggggatagaggaggagggtgtgggtgtcaggccagctcagtgaccccagcatccctggttttgcccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccgggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatggtc

SEQ ID NO: 52968 - DNA, 3392 bp, Homo sapiens
cctgccgcctccgcggcccagtcggcaccggcgaggccgtgctggaacccgggcctcagccgcagccgcagcggggccgacagtaagtgcggtgcgggctccggtgcgcgggcaggactcaggggcagggacgccccaggggcgactggccgggcggggtgcccacctctcgcgcgtgggcgcctccgggagtggtgtggccgccggtcccgccgcccgccacgctccgaggcgtcgctgtgcggacgcgggggaggcggtgggagcgagctgcgggcgctgcgcggtggccctgctgtctggcgtgtgcacgctagtgtccacacacgtgtgcgtgggctctgggtgccctggcgcggccggcacgcccatgggggccggggatgccggggcgtctgcggagagtgcaggtgggtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggtgggggaggggattggcatgtggggggcggcaaggagcttcctcatgggggaaggtgcagggagacggaggggtcccaggtggcccctagacttcctgcatcgcccctctgcccaggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttggtgagctgctccatgccctgcctgcccttgtgctgggctccggctacccttccccatgtccctggcacatgagcgcgcccccaaagaccataagcctctcccacaggctccctgggggcgggagtggggagtatgggagtggggattgttggtgtctcctgggtcgtgcctactgccccatcccgcagaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccgggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatggtc

SEQ ID NO: 52969 - DNA, 2793 bp, Homo sapiens
cctgccgcctccgcggcccagtcggcaccggcgaggccgtgctggaacccgggcctcagccgcagccgcagcggggccgacagaggtggctgatgccctgggagggggtgcggacccagaaaccaactcgaccagcaacagcagccactcagcctgggacctgggcagcgccttctttttctcagggaccatcatcaccaccatcggtgggggaggggattggcatgtggggggcggcaaggagcttcctcatgggggaaggtgcagggagacggaggggtcccaggtggcccctagacttcctgcatcgcccctctgcccaggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttggtgagctgctccatgccctgcctgcccttgtgctgggctccggctacccttccccatgtccctggcacatgagcgcgcccccaaagaccataagcctctcccacaggctccctgggggcgggagtggggagtatgggagtggggattgttggtgtctcctgggtcgtgcctactgccccatcccgcagaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccgggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatggtc

SEQ ID NO: 52970 - DNA, 3450 bp, Homo sapiens
catggaagtgagaaccaaaagctggggcagggagcaccctggagggatagccggggagcaggtagagggccaaaacctggagtgggggcaggaggtgctccagcagcaactcccccagaggtgggtcccaacctccacgtcggccaattccaggtggccccaccgggtttcccccacccctttgtcccgcggagcccctcccttcatgagtgctgagcccaagggccaggctgtccccaggggcggagagttgcgggcccttcccgatccggtaatgggcctgggagatgccagattagcgtggtgcctgtccggagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggtgggggaggggattggcatgtggggggcggcaaggagcttcctcatgggggaaggtgcagggagacggaggggtcccaggtggcccctagacttcctgcatcgcccctctgcccaggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttggtgagctgctccatgccctgcctgcccttgtgctgggctccggctacccttccccatgtccctggcacatgagcgcgcccccaaagaccataagcctctcccacaggctccctgggggcgggagtggggagtatgggagtggggattgttggtgtctcctgggtcgtgcctactgccccatcccgcagaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccgggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatggtc

SEQ ID NO: 52971 - DNA, 919 bp, Homo sapiens
taggccccttaccctgtccgctccaacccacccttggtccgactcgggcccctggcgctatttcttactcagccttggctgcccgcagcccccacccaaccccacgttctacgggatccccaacccggcccggctcagttccccagcccgctcttccttcccgctccagccatccgcgacccttggctccctccttgtatgtggcccacaggtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatggtc

SEQ ID NO: 52972 - DNA, 2875 bp, Homo sapiens
caggcttaggctctctttcggcctcccactcgccttcctttcccttctcggtgccctcctctctttcctcacccggtagtcccagacaggggctgagggccgggcagcggaggtaaggggaaggctggagataggagggggactgggtgtgtccagccagagggatgtctgtggacagtgcagctgggggctttatggatctttgggtgtgtaggggatagaggaggagggtgtgggtgtcaggccagctcagtgaccccagcatccctggttttgcccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccgggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatggtc

SEQ ID NO: 52973 - DNA, 566 bp, Homo sapiens
cacagggaggaggtgggggcatttcagctgtgggcagagatgaagtacctggacgcctaagcctcttgctgcttctccagctgccactgcccctgatggaactcatggagaatgaagctctggaaatcctcaccaaagccctccggagtaagctccccgccaacccccaagaactcccacgacagattctggtggattttgcagggctggggcccaggggggtggggtttcagggtgccttatgtcttgtcagatgcccttggcactcacaagtattccaagggccccataaaagttaaaagctgagggactgggcacaggaagacccagtgggggacatgtggtgatgggcagaggcctgggctccaggctgagtgcagcccctctccagctgagggaggcttttctgtggctgtttctccacctgcacagtgggatgaccgccttggtgtggcctcgactgcctctggttggggagttgtgaggagcctttggacagtggattatgtgggtgaacttttgctgctggggtaggaaagcccagcggtgataaagggccagctgat

SEQ ID NO: 52974 - DNA, 426 bp, Homo sapiens
catctctaatacttcatatttctcaaacagtagttctcaaacattgtatatcttggttcctgttatactgtgtctttacttctgattcttgtgcttggcacacagcactcagtacatgctgccgaatatttaaatgaatagaaagtgctttccaaaaacatgatggaaatgttcaaatttggcaagaagtggcagaggagttcaagcagcagatggaggttggtccggacgactggagagcccttctggcattcacaataaaaggagtctctggctcttgcaataagcagtgaagagttttttaaagaaagtaaagaccagacagaattgaaggaggatattgggagacccagcttttactcccagttttgtgacttattcgtaacttggaataagttacttccctctcctggtctcaacttcctt

SEQ ID NO: 52975 - DNA, 872 bp, Homo sapiens
ttcaagcaattctcctgcctcagcctcctgagtagctgggattgcaggcacacaccaccatgcccagctaattttttgtaattttagtagaagcagggtttcaccatgttggtcaggctggtctcgaactgctgacctcgtgatctgcccgcctcggcctcccaaagtgctgggattgcaggtgtaagccactgtgcctggcccagtaggcactctttaagagcaggtgtcacacagtagaaactctatgtagaccatatgtagaccatgagtcacagagtgggcacactatgaagagcaggtggcagcagtaggcactctttatgtagagcaggcagcagtgagtaggcactctttatcaggagcagatgatactcagtaaacactctttatatagagcaggtggcatctgtaggcactctttatctagagcaagtggcattcaatgggctctctctcttttttatttttttgtgagacagagtctcactctgttgcccaggctggagtgcagtggtatgaactcagctcactgcaaactctgcctcccgggttcatgagattctcctgcctcagcctcccgagtagctgggatcataggtgcccgccaccacgcccggctaatttttgtatttttagtagagatggggtttcaccatgttggccaggctggtcttgaactcccgacctcagatgatctgcctgccttggcctcccaaagtgcttggattacaggcatgagctactgtgcctggccagtaggcactctttatgtattgcaggtggtactgagtaggcactttttatgtagcgcaggcaagagtaggaactcttcatgtagagcaagcagcactcagtaggcaccctttatg

SEQ ID NO: 52976 - DNA, 770 bp, Homo sapiens
ttttttttttcagctctagaaataaagaagacagggcaggaaggactggctctcactctcggcttctttgggagattctgccattgtagacagaatcagtagcagcttctgtcatgaatttaaaactcaggagagaggatttggtggtaatctgatggaagtggaaaacaatcacgactctgagggagtgtgggtgaaacaagttgctttgtttaggttgtgttggagactgtaggtagtaatagacaatgataggacatctttttgtctgatgcctgtaagtgtacctggagactttgaagccatacttgttagttcattcctgcattactataaagaaatacctgagactgagtaatttacaaagaaaagaggtttgattggctcacggtcctgcaggctgtacacaaagcatggtgttggcatctgcttagcttctggggaggcctcaggaagtttccaatcatagcggaagacagagagcaggcatcacatggtgagggaaggggtgaggtgccaggctccttaaacaaccagatctcatgggaactaccagggcaagaactgactcattaccatggggatggcaccaacccattcatgaggggtctgtgcccatgacccaatatctcccagtaagccccatctccagcactggaggtcacatttcagtatgagatttggagaggacacatatccaaaccgtatcaccatgagttaaaccaatacatcaaatttttagggacagttggaagatcttcagagtcaag

SEQ ID NO: 52977 - DNA, 104 bp, Homo sapiens
atgactatgccctcccttgaagatggtggcttgcctctctttctgtaagcacatgtcatgtcataacaatattaaacaattaaaagtaatgtccccatcttctt

SEQ ID NO: 52978 - DNA, 292 bp, Homo sapiens
caagcctcttgtcttttctacttttggctcttgctcctagtgccatgtcccagtttaaaaggccagagtcagaggaagatgcacctctttagtgagtgctgctaaatcatcccactcataccagcatgatcaagtgggagaaaatggtcttgtatttcaaaaggattggagaagctagttatttcataagaatatagaaggtgaagttggaattagaaataatcctttacaactgccaatttaaatgaaaatatttaatgcctgtgaggttaggtcagtatcccagaatacc

SEQ ID NO: 52979 - DNA, 759 bp, Homo sapiens
gggctgggtgcggtggctcacgcctgtaattccaacactttgggagtctgaggcaggcggatcacttgaggccaggagttcgagaccaggctggccaccacggtgagaccttatgtctactaaaaatacaaaaaataggccaggtgtggtgttgtaggcctgcagtcctagctactagggaggctgaggcacacccaggaggtggacgttgcagtgagctgagatcacaccactgcactccagcctgggcaaaagagtgtgacttggtctcaaagaaaaagaagtttgtggactgcttaagtttgtgattgtcatagagtagtatttattaaatcatgaagtcagaatgtgaatatatctcctgtaatttttttttctaataataggtttgcttattctagcccattggtgccatagattgttagtctagctctattattctatgagttgtttggtgaactctaaatatttgtgcccacagtatttctggctctggtttcccaacagccagattacaccaggtctggtatgtttcaagtactgatgtttatgcacatacgcaccccgctctctgccagcgcactggaaccagtcgcctcacttctgatatgctccctctgtacaggttcacagcagtcttagaaagctcgcaggcagcccatgttctagatcaactttgataattatttatgtatttaatttgtatttcagcaaatgctctgctatttttaaaagcttactgatagcaactgactttat

SEQ ID NO: 52980 - DNA, 274 bp, Homo sapiens
gcacagagaaatgaaacaacccttgtaaggtcactaagtcaataagtagtgaaactagatgtggcagaagatgctaagtaagtgtgtattactcatcaccccatctctctttcttagtaacagaaattcttaataagaattattcaggctgggcatagtggctcactcttgtaatctcagcactttgggaggccgaggcaggtggatcacctgaggttgggagttcgagaccagcctgaccaacatggagaaaccccgtttctactaaaaatac

SEQ ID NO: 52981 - DNA, 376 bp, Homo sapiens
tttttttttttttttttggtttttgaagatatagtagttggagaggctaataaggggccttctgcactaattccactttattttttaaattggggggaaaaagtattgagaaacagattatatgaacggattagattgaggaagtgacggaaaggtagagaggaagggataaatgtataacctttgtaatgtggtatggccccacgagttactaaacatgactgaattgatgaaagattcataacatatttgtaaagcgaaattctcaataataaagcctcctttccaacttgattgctcaatatagataggattttattcttaaaggaaaaatcctcattttgcaggcagaataagccgggatacctacaattag

SEQ ID NO: 52982 - DNA, 361 bp, Homo sapiens
tcttgatgctgaaatctatccaaacatcaccagtgacatttctttgaaagtagtgcttttgtctttcagacttgcactcacgagtccttgaccaaattcttgctttctggcacaatctgaagcccaaaggctctaagaatcttactgtatcccagatatggaacttgttacatctccttctagttgtcaaaggtctttggaagccaggatctgattcatagatgagcttctgttcagaaatggcatttccatttatacttttagaagatatataaaatttatttctatgaaaaaggttattacttgacaataatatcctcagctcaaatataatgctatactgattattattcagcttcct

SEQ ID NO: 52983 - DNA, 302 bp, Homo sapiens
ccaaaaaccccagagcatccaggaagtagccaacaataccaagtgctaaaatcaccagagtccccaagtatttgccaatgagtgtctccacaccaaatgcctaaaaccctggagtatccacggtccaaccaatgtcaaaaacctgaagcattcagagtcagccagtagtgaaccccaaatgcctggctggggccacggaacaacatgactggtgctgcagagtcaacatgatggggaaacacccacaaacaagtgtcctgccttaaataattgcccaaatacagttagcagggagctaaagc

SEQ ID NO: 52984 - DNA, 219 bp, Homo sapiens
ttattttaccagaaaaaaacattgtatttgtatgaatataaaaagtacaatgagaaaaacatttactattcttacaagggctgaaaatctcatgtatttctgaagcaatctcatttgtcaaaaagtgtgacaggaaatagcccttaaaaaatggaaaacatctagtcagtatcatacaattcccatttctaaaactgcagtatgacaaagcaaaaaaaa

SEQ ID NO: 52985 - DNA, 736 bp, Homo sapiens
ggctctcaccctcctctcctgcagctccagctctgtgctctgcctctgaggagaccatggcccggcctctgtgtaccctgctactcctgatggctaccctggctggggctctggcctcgagctccaaggaggagaataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcctgcgccaagagacagacagagaaggctgcaggagtcctttgttgctcagcagggcgctctgccctccctccttccttcttgcttctaatagccctggtacatggtacacacacccccacctcctgcaattaaacagtagcatcgcc

SEQ ID NO: 52986 - DNA, 824 bp, Homo sapiens
ggctctcaccctcctctcctgcagctccagctctgtgctctgcctctgaggagaccatggcccggcctctgtgtaccctgctactcctgatggctaccctggctggggctctggcctcgagctccaaggaggagaataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcctgcgccaagagacagacagagaaggctgcaggagtcctttgttgctcagcagggcgctctgccctccctccttccttcttgcttctaatagccctggtacatggtacacacacccccacctcctgcaattaaacagtagcatcgccggggaaaagaattaaacttaaaatataacgtcttgagagggctcactggtatatttgacacaatgcactggaaataaaaaaaaactgg

SEQ ID NO: 52987 - DNA, 555 bp, Homo sapiens
ggctctcaccctcctctcctgcagctccagctctgtgctctgcctctgaggagaccatggcccggcctctgtgtaccctgctactcctgatggctaccctggctggggctctggcctcgagctccaaggaggagaataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccgtcggtgagcggtaccgagctgattt

SEQ ID NO: 52988 - DNA, 157 bp, Homo sapiens
tctgccgtgttacctgcagtatgactcagcgtgttgaaaattatagccagctacaagcacaccacttccatttttgatgacttctcacactatgagaaacgccaagaggaagaagaaagtgttaaaaaggtaacccacttcttcttattaagatttt

SEQ ID NO: 52989 - DNA, 3756 bp, Homo sapiens
  misc_feature (1)..(5): n is a, c, g, or t
  misc_feature (7)..(8): n is a, c, g, or t
  misc_feature (10)..(10): n is a, c, g, or t
  misc_feature (3746)..(3747): n is a, c, g, or t
nnnnntnntngcgattttgaagttgtcgaaagactttaatgtgtttgaaaatacctaacaacaaagcctggcccacagctggtatttcaataatgttaatttccttgcttccctcttgaggtccttaagattcataggttctccggactccttgaaagttttgtgtagatgcatgaggtgtatttttcttggaaataaagtccacaatttaacagattatcttggggccagcgatttccccgaaaataaattgtagattctccttccggcaatgctaaggggtgaatctcttttgcgggagactggattctttcggtgtgtgttttgctctctgggtactctttctgtagtcggctaacagaggatgaccaagcccctcgcgggggcgggggcgggtcactcccggacagggcccccatgaagtttccctggggactgtgtgactccctaggggtcgggttacctcccagatgggggtggggtatcacttgcagctggaaggcaggttcattttaaggtctcgcgggcttcggaggcccctccctcactgagaaaccggcttttgtcgttcttctgaagccagagctagtctttccaggtgttagtcgaaacctcgtggtgcgaccctggtcgtcccaaaccccctaggccttaatcctggggcggtgggggcggggaggccgtgagcacagcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatcagtgcctcttggcctaacgtggagctctgcggccgttccttaggagggaattataacctcctattatcgcttgctggcgtcggtgggaacggtagtnntcaaggggt

SEQ ID NO: 52990 - DNA, 3689 bp, Homo sapiens
  misc_feature (1)..(5): n is a, c, g, or t
  misc_feature (7)..(8): n is a, c, g, or t
  misc_feature (10)..(10): n is a, c, g, or t
nnnnntnntngcgattttgaagttgtcgaaagactttaatgtgtttgaaaatacctaacaacaaagcctggcccacagctggtatttcaataatgttaatttccttgcttccctcttgaggtccttaagattcataggttctccggactccttgaaagttttgtgtagatgcatgaggtgtatttttcttggaaataaagtccacaatttaacagattatcttggggccagcgatttccccgaaaataaattgtagattctccttccggcaatgctaaggggtgaatctcttttgcgggagactggattctttcggtgtgtgttttgctctctgggtactctttctgtagtcggctaacagaggatgaccaagcccctcgcgggggcgggggcgggtcactcccggacagggcccccatgaagtttccctggggactgtgtgactccctaggggtcgggttacctcccagatgggggtggggtatcacttgcagctggaaggcaggttcattttaaggtctcgcgggcttcggaggcccctccctcactgagaaaccggcttttgtcgttcttctgaagccagagctagtctttccaggtgttagtcgaaacctcgtggtgcgaccctggtcgtcccaaaccccctaggccttaatcctggggcggtgggggcggggaggccgtgagcacagcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatcacatggcctcgttggcctcagcggtggagctcgtcagccg

SEQ ID NO: 52991 - DNA, 2705 bp, Homo sapiens
gggctggtacggcccgcggagtatgggatccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 52992 - DNA, 2711 bp, Homo sapiens
gggcctggcgctttcccccgcctcccattttcagcctcttcctcactaccattcctgacgcctcccctcgggcctgctcctttattctcccttcgggccctgccttaatttgttcttccttttccatttctcctttggacaacttgctgctcggcgacgtttccttcccctgcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 52993 - DNA, 2496 bp, Homo sapiens
ccaacggctaggtacaggctgggtggtaatcggccgaggcttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 52994 - DNA, 2641 bp, Homo sapiens
acctgaaggcgggaagatctcttgagcccagaagtttgaagctgcagtgagctatctacgatcatacctgtgaaaagccactgcgctccagccttggtgacagaacaagatctgcttgagcatgtgggagcctgccagttcaggtacagacattcaactgtgtcttggcataacctgtgatattaagtgcatttgatttttctttctcagaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 52995 - DNA, 1667 bp, Homo sapiens
cctgcctcagcctcccgagtagctgggactacaggcgcccgccaccataccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 52996 - DNA, 2253 bp, Homo sapiens
  misc_feature (1)..(5): n is a, c, g, or t
  misc_feature (7)..(8): n is a, c, g, or t
  misc_feature (10)..(10): n is a, c, g, or t
nnnnntnntngcgattttgaagttgtcgaaagactttaatgtgtttgaaaatacctaacaacaaagcctggcccacagctggtatttcaataatgttaatttccttgcttccctcttgaggtccttaagattcataggttctccggactccttgaaagttttgtgtagatgcatgaggtgtatttttcttggaaataaagtccacaatttaacagattatcttggggccagcgatttccccgaaaataaattgtagattctccttccggcaatgctaaggggtgaatctcttttgcgggagactggattctttcggtgtgtgttttgctctctgggtactctttctgtagtcggctaacagaggatgaccaagcccctcgcgggggcgggggcgggtcactcccggacagggcccccatgaagtttccctggggactgtgtgactccctaggggtcgggttacctcccagatgggggtggggtatcacttgcagctggaaggcaggttcattttaaggtctcgcgggcttcggaggcccctccctcactgagaaaccggcttttgtcgttcttctgaagccagagctagtctttccaggtgttagtcgaaacctcgtggtgcgaccctggtcgtcccaaaccccctaggccttaatcctggggcggtgggggcggggaggccgtgagcacagcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggctgacctatattctgacaaagcctgtgaggggctttgcacgggagaacggtacgagctgattatcgg

SEQ ID NO: 52997 - DNA, 2066 bp, Homo sapiens
  misc_feature (1)..(5): n is a, c, g, or t
  misc_feature (7)..(8): n is a, c, g, or t
  misc_feature (10)..(10): n is a, c, g, or t
nnnnntnntngcgattttgaagttgtcgaaagactttaatgtgtttgaaaatacctaacaacaaagcctggcccacagctggtatttcaataatgttaatttccttgcttccctcttgaggtccttaagattcataggttctccggactccttgaaagttttgtgtagatgcatgaggtgtatttttcttggaaataaagtccacaatttaacagattatcttggggccagcgatttccccgaaaataaattgtagattctccttccggcaatgctaaggggtgaatctcttttgcgggagactggattctttcggtgtgtgttttgctctctgggtactctttctgtagtcggctaacagaggatgaccaagcccctcgcgggggcgggggcgggtcactcccggacagggcccccatgaagtttccctggggactgtgtgactccctaggggtcgggttacctcccagatgggggtggggtatcacttgcagctggaaggcaggttcattttaaggtctcgcgggcttcggaggcccctccctcactgagaaaccggcttttgtcgttcttctgaagccagagctagtctttccaggtgttagtcgaaacctcgtggtgcgaccctggtcgtcccaaaccccctaggccttaatcctggggcggtgggggcggggaggccgtgagcacagcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccgaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 52998 - DNA, 1150 bp, Homo sapiens
gggttacttccattaggcccatatttttggggggcctgacaactaagtattaatctaaacagtataataggaaagcatgtaatgaattttcaagtcaaaagtaattttgcattaaggtgtttaagtgtttaaaacaaagtaaaagccagtttttctttgtggggaatgttctacttagaataattaattttctaataattctaaataattaaatttctgttgagttattctgtgaagtttttaaattcataaagcatgttcagataatttttaaccatttcaatttttttcttacctctgtaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 52999 - DNA, 924 bp, Homo sapiens
cctctggcccttaagtgatccacctgcctcggcctcaaagtactgagattacagacatgagccaccacacccagcctgaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 53000 - DNA, 1365 bp, Homo sapiens
  misc_feature (1)..(5): n is a, c, g, or t
  misc_feature (7)..(8): n is a, c, g, or t
  misc_feature (10)..(10): n is a, c, g, or t
nnnnntnntngcgattttgaagttgtcgaaagactttaatgtgtttgaaaatacctaacaacaaagcctggcccacagctggtatttcaataatgttaatttccttgcttccctcttgaggtccttaagattcataggttctccggactccttgaaagttttgtgtagatgcatgaggtgtatttttcttggaaataaagtccacaatttaacagattatcttggggccagcgatttccccgaaaataaattgtagattctccttccggcaatgctaaggggtgaatctcttttgcgggagactggattctttcggtgtgtgttttgctctctgggtactctttctgtagtcggctaacagaggatgaccaagcccctcgcgggggcgggggcgggtcactcccggacagggcccccatgaagtttccctggggactgtgtgactccctaggggtcgggttacctcccagatgggggtggggtatcacttgcagctggaaggcaggttcattttaaggtctcgcgggcttcggaggcccctccctcactgagaaaccggcttttgtcgttcttctgaagccagagctagtctttccaggtgttagtcgaaacctcgtggtgcgaccctggtcgtcccaaaccccctaggccttaatcctggggcggtgggggcggggaggccgtgagcacagcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcaggtacaggcccggcccgcatgcctcggccattgtgtgaggcgagaaggagcccgactaggcccgggcccgccgctcctgggcaggccgagccgagccgaggcgtcgtctcttgcgggccaggtttcgggcctctcaggccggccgcgcccggcgcctctccctcagcctgttcttcccgcttctcctcgggcctcggagcccacgggccgggccgcgccgcgttcccttctctcggcgggcctcgttttcct

SEQ ID NO: 53001 - DNA, 3650 bp, Homo sapiens
  misc_feature (1)..(5): n is a, c, g, or t
  misc_feature (7)..(8): n is a, c, g, or t
  misc_feature (10)..(10): n is a, c, g, or t
nnnnntnntngcgattttgaagttgtcgaaagactttaatgtgtttgaaaatacctaacaacaaagcctggcccacagctggtatttcaataatgttaatttccttgcttccctcttgaggtccttaagattcataggttctccggactccttgaaagttttgtgtagatgcatgaggtgtatttttcttggaaataaagtccacaatttaacagattatcttggggccagcgatttccccgaaaataaattgtagattctccttccggcaatgctaaggggtgaatctcttttgcgggagactggattctttcggtgtgtgttttgctctctgggtactctttctgtagtcggctaacagaggatgaccaagcccctcgcgggggcgggggcgggtcactcccggacagggcccccatgaagtttccctggggactgtgtgactccctaggggtcgggttacctcccagatgggggtggggtatcacttgcagctggaaggcaggttcattttaaggtctcgcgggcttcggaggcccctccctcactgagaaaccggcttttgtcgttcttctgaagccagagctagtctttccaggtgttagtcgaaacctcgtggtgcgaccctggtcgtcccaaaccccctaggccttaatcctggggcggtgggggcggggaggccgtgagcacagcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 53002 - DNA, 3618 bp, Homo sapiens
  misc_feature (1)..(5): n is a, c, g, or t
  misc_feature (7)..(8): n is a, c, g, or t
  misc_feature (10)..(10): n is a, c, g, or t
nnnnntnntngcgattttgaagttgtcgaaagactttaatgtgtttgaaaatacctaacaacaaagcctggcccacagctggtatttcaataatgttaatttccttgcttccctcttgaggtccttaagattcataggttctccggactccttgaaagttttgtgtagatgcatgaggtgtatttttcttggaaataaagtccacaatttaacagattatcttggggccagcgatttccccgaaaataaattgtagattctccttccggcaatgctaaggggtgaatctcttttgcgggagactggattctttcggtgtgtgttttgctctctgggtactctttctgtagtcggctaacagaggatgaccaagcccctcgcgggggcgggggcgggtcactcccggacagggcccccatgaagtttccctggggactgtgtgactccctaggggtcgggttacctcccagatgggggtggggtatcacttgcagctggaaggcaggttcattttaaggtctcgcgggcttcggaggcccctccctcactgagaaaccggcttttgtcgttcttctgaagccagagctagtctttccaggtgttagtcgaaacctcgtggtgcgaccctggtcgtcccaaaccccctaggccttaatcctggggcggtgggggcggggaggccgtgagcacagcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcaccaatcccccgttctcctcctatcccacaaccccgccatcatttccgggttttcctctta

SEQ ID NO: 53003 - DNA, 3413 bp, Homo sapiens
  misc_feature (1)..(5): n is a, c, g, or t
  misc_feature (7)..(8): n is a, c, g, or t
  misc_feature (10)..(10): n is a, c, g, or t
nnnnntnntngcgattttgaagttgtcgaaagactttaatgtgtttgaaaatacctaacaacaaagcctggcccacagctggtatttcaataatgttaatttccttgcttccctcttgaggtccttaagattcataggttctccggactccttgaaagttttgtgtagatgcatgaggtgtatttttcttggaaataaagtccacaatttaacagattatcttggggccagcgatttccccgaaaataaattgtagattctccttccggcaatgctaaggggtgaatctcttttgcgggagactggattctttcggtgtgtgttttgctctctgggtactctttctgtagtcggctaacagaggatgaccaagcccctcgcgggggcgggggcgggtcactcccggacagggcccccatgaagtttccctggggactgtgtgactccctaggggtcgggttacctcccagatgggggtggggtatcacttgcagctggaaggcaggttcattttaaggtctcgcgggcttcggaggcccctccctcactgagaaaccggcttttgtcgttcttctgaagccagagctagtctttccaggtgttagtcgaaacctcgtggtgcgaccctggtcgtcccaaaccccctaggccttaatcctggggcggtgggggcggggaggccgtgagcacagcttccgctcctccaatccgccagagggcgcagcggccggcctctcccttcccggggttcttcgcgccgggccccttccgcgtggccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 53004 - DNA, 2557 bp, Homo sapiens
  misc_feature (1)..(5): n is a, c, g, or t
  misc_feature (7)..(8): n is a, c, g, or t
  misc_feature (10)..(10): n is a, c, g, or t
nnnnntnntngcgattttgaagttgtcgaaagactttaatgtgtttgaaaatacctaacaacaaagcctggcccacagctggtatttcaataatgttaatttccttgcttccctcttgaggtccttaagattcataggttctccggactccttgaaagttttgtgtagatgcatgaggtgtatttttcttggaaataaagtccacaatttaacagattatcttggggccagcgatttccccgaaaataaattgtagattctccttccggcaatgctaaggggtgaatctcttttgcgggagactggattctttcggtgtgtgttttgctctctgggtactctttctgtagtcggctaacagaggatgaccaagcccctcgcgggggcgggggcgggtcactcccggacagggcccccatgaagtttccctggggactgtgtgactccctaggggtcgggttacctcccagatgggggtggggtatcacttgcagctggaaggcaggttcattttaaggtctcgcgggcttcggaggcccctccctcactgagaaaccggcttttgtcgttcttctgaagccagagctagtctttccaggtgttagtcgaaacctcgtggtgcgaccctggtcgtcccaaaccccctaggccttaatcctggggcggtgggggcggggaggccgtgagcacagcttccgctcctccaatccgccagagggcgcagcggccggcctctcccttcccggggttcttcgcgccgggccccttccgcgtgggtgagtgaatgtgagagtcagcgctcgcgccgcgcgcgccgcccgcctccgctgttcggcgctctgctttaggcggtggggggcgggcgcgcgcgtaaaagcatagagacgggcattgagctcttgggctagagcgtcgccgagtcggagccggagcctgagccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttcttcctcttggcgtttctcatagtgtgagaagtcatcaaaaatggaagtggtgtgcttgtagctggctataattttcaacacctgcttagcctttt

SEQ ID NO: 53005 - DNA, 1089 bp, Homo sapiens
acacattcgcctagagaacaacgagaataaaccagtgaccaactctaggcgaatgtgtcgcattggctattgggaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatca

SEQ ID NO: 53006 - DNA, 598 bp, Homo sapiens
cccctcagggttcaggcctcagctgaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatgctggagtgccatgacgtgatcttgggtcactgcaagctctgtctcccaggttcaaagccggggttcaccgtattagccaggatggtct

SEQ ID NO: 53007 - DNA, 1108 bp, Homo sapiens
tggttatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctggcaagaaagcctctttgcaaccgggtcagaatggcggcagtgggagcatccgtcattcttcaggattggcctaactgggcctaacctcaacaggctgaaactttaaaaaaacggatggggcaccaaggcactcctccattcaaaaagattctataattggtaaatccctgaggctcagacaccttccgagtgtgtgcttatcccttcaccctcacggatggtatctcaggaacctccggggtttgttcctcccttcacttgtttactccgg

SEQ ID NO: 53008 - DNA, 1306 bp, Homo sapiens
gctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctggcaagaaagcctctttgcaaccgggtcagaatggcggcagtgggagcatccgtcattcttcaggattggcctaactgggcctaacctcaacaggctgaaactttaaaaaaacggatggggcaccaaggcactcctccattcaaaaagattctataattggtaaatccctgaggctcagacaccttccgagtgtgtgcttatcccttcaccctcacggatggtatctcaggaacctccggggtttgttcctcccttcacttgtttactccgg

SEQ ID NO: 53009 - DNA, 1262 bp, Homo sapiens
gctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagagagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctggcaagaaagcctctttgcaaccgggtcagaatggcggcagtgggagcatccgtcattcttcaggattggcctaactgggcctaacctcaacaggctgaaactttaaaaaaacggatggggcaccaaggcactcctccattcaaaaagattctataattggtaaatccctgaggctcagacaccttccgagtgtgtgcttatcccttcaccctcacggatggtatctcaggaacctccggggtttgttcctcccttcacttgtttactccgg

SEQ ID NO: 53010 - DNA, 238 bp, Homo sapiens
ggagtacacagggaaactgagtggtaagcagggccatcgctttgaggtggagaaggtcgggccatctcaatcacggctgctctctgccttgcttccttgaatttgtgacacagccgcccactgcctctgttgagattacatcataaattactcaggcataagcagaccagagataagagcagtcagaggcagcccagaaaccaaacaaggggtgctggcatttgttaaaaaaaaaaaa

SEQ ID NO: 53011 - DNA, 341 bp, Homo sapiens
atcaagcaccgaatgaatggcatttaaaaaatatgtaatcaggcgtacaggactgataggaaggctgctataaaaaatatatataattgatacttctttgggcccctgtttggagcagtgtgaaaaaaattttaaagattttttaaaaagcgttgaggtataatttacatatcataaagttaacttaaagtaggttgtagtgagtttacgcagcgtgcaagtctcaccgcaatctagtgttttgtttattgttttgtttttgaagcaggataaatttttaagtaactgctacagagaggtcttgcagcgctcccaccttcctgggaaaatgctttgtttct

SEQ ID NO: 53012 - DNA, 4233 bp, Homo sapiens
  misc_feature (37)..(38): n is a, c, g, or t
gcgccgcggggcccaagcccgggtctgccagcgcganntcctctcgcggccctcagggcacagcccaaggctgtcagcctcccggcccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggca

SEQ ID NO: 53013 - DNA, 1086 bp, Homo sapiens
gagaagagttggagcagtgagtcagaaagaccttagtctgaattccagatttccaatttattgatcatttgccttggagaaaatatgcaacttctttaagctttgattctgtcttttgcaaaatgaggataatgatttttccctcttgtggatctcatgacactgtgacaacacaaataaaacatgtggcaaagcccctggcacttacctcaggggttggctcttttacagcatttggtcaggtttagtatttttagatccagtaatgactccatttaaatttaggtacttttatgtgtatttgtgcatgatagcaaatccagaaaaaatcaatttatataaatggtataagtgcaaatacaatataagtatttaatatgttaatattcctaattggcaggaaaatatattgaaatctctaagctaatagaccaaaggttttaataatctctctctcacttttcctttgaaaagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattgattggtaagcacttgtgggcttctgccttcatgtgaactccagtttctcaatatatatttctaaggtccatattgatgaaataattaaattttgttcatggaagttgcttcagttaatattattttggtgaaaattcattccagttggtgtaattctcattcaaatacattttagaacactgaataaatgcatcaactgagtcaaaatatcctatactcaattcttatcttcctttactgactgtgtcccgttagctgataatggaatgggggattggaatccttatgtatgtactatacataagctaacttttgttctgctgggtataaataacagccaaagattctgcttcatagacctgttaaagacttgagcagcttatgcatgcggccgcatttcggcttacttgcccaat

SEQ ID NO: 53014 - DNA, 1050 bp, Homo sapiens
gtatccccatttgttggagtctgggtcaagtaaggaggttttttgggttcaatggtggcaggtccctcatgaatggctgggttctgtccctggtggtaatgaggtgagtttcttattccagttagctcatgttagagctggttttgaaaagagtctagtgtctttctcacctgttctcgttgctccctttgtggccatgtgatatgcctgctcctcctcttcgccttcgcaccatgattgtaagcttctgttttctgtgtctgtgcggtctgtctgtgtgtttttgagatagagtatcactctgttgcccaggctggagtacagtggtgtgatctcagctcacagcaacctctgcctcccaagttccaagtgatcctcttgcctcagcctcctgagtagcagggactccagacacatgccaccatgcccagctaatttttgtatttttagtagagatggggtttcaccatgttggccagcctggtctcgaactcctgacctcaaatgatccatctgtctccgcctcccgaagtgctggcattacaggcatgagccaccgcacgcggccaattgtaaacttcttgaggttgtcaccagaagcagatgctggcatcatgcttcttgtacagcctagaaaggcctgtctgtctagattcttcttggcatctctgagcatggatttcattctggatatggggcaggatgctctctggaatgagggtctttagacctgtttctttgttctgatgggaccccagagaggacatcacgctttgtaactggttcttcaaggggagaagcaaatgtgtccctgaaaacttcagctgccgcgtttggcaccaggtttgattgacaaggactggcggagggaaagcgcggaggctgggctgggggccgcaggccgaggcagagacaaagaggtttcgcctgtccccgagagtggaagggcccctgggggtaactagcctttgagctcaaaggggcatttcgtgaggtcgccttttggttcggagagcgcgcggcgatcgggtggagggggcctggcgggaa

SEQ ID NO: 53015 - DNA, 905 bp, Homo sapiens
cggacgcgtgggtcgacccacgcgtccgccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaaaaaaaaaaaaaaaaaaaaaaaaaaaaaaaaaaaaaaaaaaaaaacaaaaaaaaaaaaaaaaaaaaaagaaaaaaaagaaaaaaaaaaggaggggggggggataaaaaaatccacaggaggggaggagaaaataagagagcgaacaagatgtaattatgtaaagacaacgacagcccaccacaaaaacggagggagaaaacaataaaaacaacaccagcagcggcgcgcggccagcctaaaaccactcagacgtgatagtatcaagacaaaacatcgtcagaatgaagagaactactgcagagaaagagcacacgaccattctatctggtgagaagacgacatatagagggcagcaccacaacaatacacaaagtagaacccactacaaagtaaagaaaaacaataaaaaagaagttaatgatagaacaaaacaacgatacataacgtagccgggaaacaacgtacaacagcaatgagtgagcaacaaactatacacggcg

SEQ ID NO: 53016 - DNA, 4986 bp, Homo sapiens
gtatccccatttgttggagtctgggtcaagtaaggaggttttttgggttcaatggtggcaggtccctcatgaatggctgggttctgtccctggtggtaatgaggtgagtttcttattccagttagctcatgttagagctggttttgaaaagagtctagtgtctttctcacctgttctcgttgctccctttgtggccatgtgatatgcctgctcctcctcttcgccttcgcaccatgattgtaagcttctgttttctgtgtctgtgcggtctgtctgtgtgtttttgagatagagtatcactctgttgcccaggctggagtacagtggtgtgatctcagctcacagcaacctctgcctcccaagttccaagtgatcctcttgcctcagcctcctgagtagcagggactccagacacatgccaccatgcccagctaatttttgtatttttagtagagatggggtttcaccatgttggccagcctggtctcgaactcctgacctcaaatgatccatctgtctccgcctcccgaagtgctggcattacaggcatgagccaccgcacgcggccaattgtaaacttcttgaggttgtcaccagaagcagatgctggcatcatgcttcttgtacagcctagaaaggcctgtctgtctagattcttcttggcatctctgagcatggatttcattctggatatggggcaggatgctctctggaatgagggtctttagacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggca

SEQ ID NO: 53017 - DNA, 4319 bp, Homo sapiens
gaagttctgatttttcctagcgagctggaggaaaggcaggtacccggagtggagttatattacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggca

SEQ ID NO: 53018 - DNA, 5245 bp, Homo sapiens
gtatccccatttgttggagtctgggtcaagtaaggaggttttttgggttcaatggtggcaggtccctcatgaatggctgggttctgtccctggtggtaatgaggtgagtttcttattccagttagctcatgttagagctggttttgaaaagagtctagtgtctttctcacctgttctcgttgctccctttgtggccatgtgatatgcctgctcctcctcttcgccttcgcaccatgattgtaagcttctgttttctgtgtctgtgcggtctgtctgtgtgtttttgagatagagtatcactctgttgcccaggctggagtacagtggtgtgatctcagctcacagcaacctctgcctcccaagttccaagtgatcctcttgcctcagcctcctgagtagcagggactccagacacatgccaccatgcccagctaatttttgtatttttagtagagatggggtttcaccatgttggccagcctggtctcgaactcctgacctcaaatgatccatctgtctccgcctcccgaagtgctggcattacaggcatgagccaccgcacgcggccaattgtaaacttcttgaggttgtcaccagaagcagatgctggcatcatgcttcttgtacagcctagaaaggcctgtctgtctagattcttcttggcatctctgagcatggatttcattctggatatggggcaggatgctctctggaatgagggtctttagacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttataga

SEQ ID NO: 53019 - DNA, 6711 bp, Homo sapiens
gtatccccatttgttggagtctgggtcaagtaaggaggttttttgggttcaatggtggcaggtccctcatgaatggctgggttctgtccctggtggtaatgaggtgagtttcttattccagttagctcatgttagagctggttttgaaaagagtctagtgtctttctcacctgttctcgttgctccctttgtggccatgtgatatgcctgctcctcctcttcgccttcgcaccatgattgtaagcttctgttttctgtgtctgtgcggtctgtctgtgtgtttttgagatagagtatcactctgttgcccaggctggagtacagtggtgtgatctcagctcacagcaacctctgcctcccaagttccaagtgatcctcttgcctcagcctcctgagtagcagggactccagacacatgccaccatgcccagctaatttttgtatttttagtagagatggggtttcaccatgttggccagcctggtctcgaactcctgacctcaaatgatccatctgtctccgcctcccgaagtgctggcattacaggcatgagccaccgcacgcggccaattgtaaacttcttgaggttgtcaccagaagcagatgctggcatcatgcttcttgtacagcctagaaaggcctgtctgtctagattcttcttggcatctctgagcatggatttcattctggatatggggcaggatgctctctggaatgagggtctttagacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgt

SEQ ID NO: 53020 - DNA, 5587 bp, Homo sapiens
  misc_feature (5587)..(5587): n is a, c, g, or t
gtatccccatttgttggagtctgggtcaagtaaggaggttttttgggttcaatggtggcaggtccctcatgaatggctgggttctgtccctggtggtaatgaggtgagtttcttattccagttagctcatgttagagctggttttgaaaagagtctagtgtctttctcacctgttctcgttgctccctttgtggccatgtgatatgcctgctcctcctcttcgccttcgcaccatgattgtaagcttctgttttctgtgtctgtgcggtctgtctgtgtgtttttgagatagagtatcactctgttgcccaggctggagtacagtggtgtgatctcagctcacagcaacctctgcctcccaagttccaagtgatcctcttgcctcagcctcctgagtagcagggactccagacacatgccaccatgcccagctaatttttgtatttttagtagagatggggtttcaccatgttggccagcctggtctcgaactcctgacctcaaatgatccatctgtctccgcctcccgaagtgctggcattacaggcatgagccaccgcacgcggccaattgtaaacttcttgaggttgtcaccagaagcagatgctggcatcatgcttcttgtacagcctagaaaggcctgtctgtctagattcttcttggcatctctgagcatggatttcattctggatatggggcaggatgctctctggaatgagggtctttagacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttgcaggacttttttctcagggctgttatcn

SEQ ID NO: 53021 - DNA, 5025 bp, Homo sapiens
gtatccccatttgttggagtctgggtcaagtaaggaggttttttgggttcaatggtggcaggtccctcatgaatggctgggttctgtccctggtggtaatgaggtgagtttcttattccagttagctcatgttagagctggttttgaaaagagtctagtgtctttctcacctgttctcgttgctccctttgtggccatgtgatatgcctgctcctcctcttcgccttcgcaccatgattgtaagcttctgttttctgtgtctgtgcggtctgtctgtgtgtttttgagatagagtatcactctgttgcccaggctggagtacagtggtgtgatctcagctcacagcaacctctgcctcccaagttccaagtgatcctcttgcctcagcctcctgagtagcagggactccagacacatgccaccatgcccagctaatttttgtatttttagtagagatggggtttcaccatgttggccagcctggtctcgaactcctgacctcaaatgatccatctgtctccgcctcccgaagtgctggcattacaggcatgagccaccgcacgcggccaattgtaaacttcttgaggttgtcaccagaagcagatgctggcatcatgcttcttgtacagcctagaaaggcctgtctgtctagattcttcttggcatctctgagcatggatttcattctggatatggggcaggatgctctctggaatgagggtctttagacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaatagttagtttttggggaccctttaggggattttatcggacactataggggcattaaggggggggggacttgggtaaagggtcttgggaaaaaagggggggaatccggcagagaacttaaggaaggataaaaaagggaggagagattagtgtggtgcaaaaattatgtttggtattatacgtc

SEQ ID NO: 53022 - DNA, 2701 bp, Homo sapiens
gagaagagttggagcagtgagtcagaaagaccttagtctgaattccagatttccaatttattgatcatttgccttggagaaaatatgcaacttctttaagctttgattctgtcttttgcaaaatgaggataatgatttttccctcttgtggatctcatgacactgtgacaacacaaataaaacatgtggcaaagcccctggcacttacctcaggggttggctcttttacagcatttggtcaggtttagtatttttagatccagtaatgactccatttaaatttaggtacttttatgtgtatttgtgcatgatagcaaatccagaaaaaatcaatttatataaatggtataagtgcaaatacaatataagtatttaatatgttaatattcctaattggcaggaaaatatattgaaatctctaagctaatagaccaaaggttttaataatctctctctcacttttcctttgaaaagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggca

SEQ ID NO: 53023 - DNA, 4677 bp, Homo sapiens
taacaacagtctgagaaggcactttgattgctgtattgcagatgataagcagcttgccgaagatcacccagaactagttagtaacagagtcaggattttgacctaagctctctgactcttactcactgtgtctttttctttactccatgctttagagagaaaaagtaaatttcgatagtaagatctgctgcttttgtgcgattctgcttttttaaattatggtttttttttttttttgttatgtcttgattcaggataacttggccaagtcctgtgacttttacttatttttatttactttttctttctttctttttttctttctttaagtggtgatggagcttctgtgtggaagagtttggtgctttgaagcctagagcctgcttattccctctggtcactctttgccccatttcctatagacttacccctgtccccaaacacagcaccaaacaccccattatcaagatcaattcacatgacctctgagacactgcccagagctcactggagcacagtctgactagcctagtctttgtaaaggcagaaggacatgtggggcatgatggggtggggtgggcaatttgtaagcttcactgattctgtggggtggcattttttttctacaggaacaaagtgttgctttcaattgactgtttatgggatatataacaggactttactctggaaggcccgttccagactggagacaatgttcttactttgtttcttagaaggcgggggtagggggagacttgtttctgaggaattttttggttctcttgttgctgatccttccatgattagggacattagttacattgcttcagacttacggagagttgctcaaaatggttcagaattgtggttgctcatcagctgttcctttcagaagcattttggctgaaaatagaggttggggtagatgtttcaccaatgttgtacccatctttgaaatgtgttttgatgtttgatgaacaaagaaaaaccttataatttgatagggtaaaggtagttagaatgccacactgggacttttagtagaaggaacttttagacagtggaaaagaatctgttaatcttcaacatacgtaatgctgatcatgcttaggtagttttacacggatattctgattattaggctatttttagtgaattgttgttggcctttgctagcagttgtttctttgataaaatttcaagatcagtggtggttcagttaaagaatagtctatgtactccatacagttactaagggctgatcatcattatcaccatctgcaccgccatttattgatgctaaacttatactaggcaccaataattgttagctgatgatttttcattattagttgataatgagccttaacacataactgggtctgtcttctagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggca

SEQ ID NO: 53024 - DNA, 1027 bp, Homo sapiens
ctacctgtattccagcgtgtccagcctttaggctggaatcaaagcagggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggca

SEQ ID NO: 53025 - DNA, 941 bp, Homo sapiens
gagagagagagagagagagagagagagagagagagagagagagagagagagagagagagagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggca

SEQ ID NO: 53026 - DNA, 3458 bp, Homo sapiens
taacaacagtctgagaaggcactttgattgctgtattgcagatgataagcagcttgccgaagatcacccagaactagttagtaacagagtcaggattttgacctaagctctctgactcttactcactgtgtctttttctttactccatgctttagagagaaaaagtaaatttcgatagtaagatctgctgcttttgtgcgattctgcttttttaaattatggtttttttttttttttgttatgtcttgattcaggataacttggccaagtcctgtgacttttacttatttttatttactttttctttctttctttttttctttctttaagtggtgatggagcttctgtgtggaagagtttggtgctttgaagcctagagcctgcttattccctctggtcactctttgccccatttcctatagacttacccctgtccccaaacacagcaccaaacaccccattatcaagatcaattcacatgacctctgagacactgcccagagctcactggagcacagtctgactagcctagtctttgtaaaggcagaaggacatgtggggcatgatggggtggggtgggcaatttgtaagcttcactgattctgtggggtggcattttttttctacaggaacaaagtgttgctttcaattgactgtttatgggatatataacaggactttactctggaaggcccgttccagactggagacaatgttcttactttgtttcttagaaggcgggggtagggggagacttgtttctgaggaattttttggttctcttgttgctgatccttccatgattagggacattagttacattgcttcagacttacggagagttgctcaaaatggttcagaattgtggttgctcatcagctgttcctttcagaagcattttggctgaaaatagaggttggggtagatgtttcaccaatgttgtacccatctttgaaatgtgttttgatgtttgatgaacaaagaaaaaccttataatttgatagggtaaaggtagttagaatgccacactgggacttttagtagaaggaacttttagacagtggaaaagaatctgttaatcttcaacatacgtaatgctgatcatgcttaggtagttttacacggatattctgattattaggctatttttagtgaattgttgttggcctttgctagcagttgtttctttgataaaatttcaagatcagtggtggttcagttaaagaatagtctatgtactccatacagttactaagggctgatcatcattatcaccatctgcaccgccatttattgatgctaaacttatactaggcaccaataattgttagctgatgatttttcattattagttgataatgagccttaacacataactgggtctgtcttctagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctattggtaagcacttgtgggcttctgccttcatgtgaactccagtttctcaatatatatttctaaggtccatattgatgaaataattaaattttgttcatggaagttgcttcagttaatattattttggtgaaaattcattccagttggtgtaattctcattcaaatacattttagaacactgaataaatgcatcaactgagtcaaaatatcctatactcaattcttatcttcctttactgactgtgtcccgttagctgataatggaatgggggattggaatccttatgtatgtactatacataagctaacttttgttctgctgggtataaataacagccaaagattctgcttcatagacctgttaaaaatgaaaaaaaaaaaaaaaaacatgtgccagcagaaaaactactgttttaattttattcagttgtttgctggattgttaaattttcaggaatttttaggctgggcatggtggctcagactgtaatcccagcactttgggaggctgatgtgggtggatcacttgaggccaggagtttgaaactggcctggccaacatggtgaaaccccgtcgctattaaatatacaaaaattagttgggcatggtggcgtacaactgtaatcccagcttcttgggtggctgaagcatgataatcgcttgaacctgggatgtggaggttgcagtgagctgtgatcatgctgctgcactccagcctgggtgacaaagcgagactctgtctcaaaaaaaaaa

SEQ ID NO: 53027 - DNA, 2305 bp, Homo sapiens
taacaacagtctgagaaggcactttgattgctgtattgcagatgataagcagcttgccgaagatcacccagaactagttagtaacagagtcaggattttgacctaagctctctgactcttactcactgtgtctttttctttactccatgctttagagagaaaaagtaaatttcgatagtaagatctgctgcttttgtgcgattctgcttttttaaattatggtttttttttttttttgttatgtcttgattcaggataacttggccaagtcctgtgacttttacttatttttatttactttttctttctttctttttttctttctttaagtggtgatggagcttctgtgtggaagagtttggtgctttgaagcctagagcctgcttattccctctggtcactctttgccccatttcctatagacttacccctgtccccaaacacagcaccaaacaccccattatcaagatcaattcacatgacctctgagacactgcccagagctcactggagcacagtctgactagcctagtctttgtaaaggcagaaggacatgtggggcatgatggggtggggtgggcaatttgtaagcttcactgattctgtggggtggcattttttttctacaggaacaaagtgttgctttcaattgactgtttatgggatatataacaggactttactctggaaggcccgttccagactggagacaatgttcttactttgtttcttagaaggcgggggtagggggagacttgtttctgaggaattttttggttctcttgttgctgatccttccatgattagggacattagttacattgcttcagacttacggagagttgctcaaaatggttcagaattgtggttgctcatcagctgttcctttcagaagcattttggctgaaaatagaggttggggtagatgtttcaccaatgttgtacccatctttgaaatgtgttttgatgtttgatgaacaaagaaaaaccttataatttgatagggtaaaggtagttagaatgccacactgggacttttagtagaaggaacttttagacagtggaaaagaatctgttaatcttcaacatacgtaatgctgatcatgcttaggtagttttacacggatattctgattattaggctatttttagtgaattgttgttggcctttgctagcagttgtttctttgataaaatttcaagatcagtggtggttcagttaaagaatagtctatgtactccatacagttactaagggctgatcatcattatcaccatctgcaccgccatttattgatgctaaacttatactaggcaccaataattgttagctgatgatttttcattattagttgataatgagccttaacacataactgggtctgtcttctagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtgaggataccatttaccagggtttagtcttgattgtttgattttgcaagttatatatatatatatctatagatatatgtgtagctatatatacgtatatatagatatatatacacatatatatctacacatctatctatctatctctctctctc

SEQ ID NO: 53028 - DNA, 708 bp, Homo sapiens
ttccatttctacacttcacacccacaaccttgttaatttggccactttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttataga

SEQ ID NO: 53029 - DNA, 1425 bp, Homo sapiens
gagaagagttggagcagtgagtcagaaagaccttagtctgaattccagatttccaatttattgatcatttgccttggagaaaatatgcaacttctttaagctttgattctgtcttttgcaaaatgaggataatgatttttccctcttgtggatctcatgacactgtgacaacacaaataaaacatgtggcaaagcccctggcacttacctcaggggttggctcttttacagcatttggtcaggtttagtatttttagatccagtaatgactccatttaaatttaggtacttttatgtgtatttgtgcatgatagcaaatccagaaaaaatcaatttatataaatggtataagtgcaaatacaatataagtatttaatatgttaatattcctaattggcaggaaaatatattgaaatctctaagctaatagaccaaaggttttaataatctctctctcacttttcctttgaaaagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattgattggtaagcacttgtgggcttctgccttcatgtgaactccagtttctcaatatatatttctaaggtccatattgatgaaataattaaattttgttcatggaagttgcttcagttaatattattttggtgaaaattcattccagttggtgtaattctcattcaaatacattttagaacactgaataaatgcatcaactgagtcaaaatatcctatactcaattcttatcttcctttactgactgtgtcccgttagctgataatggaatgggggattggaatccttatgtatgtactatacataagctaacttttgttctgctgggtataaataacagccaaagattctgcttcatagacctgttaaaaatgaaaaaaaaaaaaaaaaacatgtgccagcagaaaaactactgttttaattttattcagttgtttgctggattgttaaattttcaggaatttttaggctgggcatggtggctcagactgtaatcccagcactttgggaggctgatgtgggtggatcacttgaggccaggagtttgaaactggcctggccaacatggtgaaaccccgtcgctattaaatatacaaaaattagttgggcatggtggcgtacaactgtaatcccagcttcttgggtggctgaagcatgataatcgcttgaacctgggatgtggaggttgcagtgagctgtgatcatgctgctgcactccagcctgggtgacaaagcgagactctgtctcaaaaaaaaaa

SEQ ID NO: 53030 - DNA, 1107 bp, Homo sapiens
aacggagggggggggggtggttaacaaacttttaagttaataaagcattgtatgatctagtcctagaatcaggctgatatcctttattataaaagtaccctttattctgcctttctcttcaagagtgagttaattaaaaaacattttttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgt

SEQ ID NO: 53031 - DNA, 167 bp, Homo sapiens
tttatgttattaattttgagttctgatttgattgttgttctagggtgtgactttgacagctgctattgggggtgctgacatgcccgtcgttatcactgtgctgaacagctactcaggctgggccctgtgtgcagagggcttcctgctcaacaacaatctgctgacca

SEQ ID NO: 53032 - DNA, 5700 bp, Homo sapiens
gtatccccatttgttggagtctgggtcaagtaaggaggttttttgggttcaatggtggcaggtccctcatgaatggctgggttctgtccctggtggtaatgaggtgagtttcttattccagttagctcatgttagagctggttttgaaaagagtctagtgtctttctcacctgttctcgttgctccctttgtggccatgtgatatgcctgctcctcctcttcgccttcgcaccatgattgtaagcttctgttttctgtgtctgtgcggtctgtctgtgtgtttttgagatagagtatcactctgttgcccaggctggagtacagtggtgtgatctcagctcacagcaacctctgcctcccaagttccaagtgatcctcttgcctcagcctcctgagtagcagggactccagacacatgccaccatgcccagctaatttttgtatttttagtagagatggggtttcaccatgttggccagcctggtctcgaactcctgacctcaaatgatccatctgtctccgcctcccgaagtgctggcattacaggcatgagccaccgcacgcggccaattgtaaacttcttgaggttgtcaccagaagcagatgctggcatcatgcttcttgtacagcctagaaaggcctgtctgtctagattcttcttggcatctctgagcatggatttcattctggatatggggcaggatgctctctggaatgagggtctttagacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaaaaaaaaaaaaaaaaaaaaaaagaaaaaaaagaaaaaaaaaaggaggggggggggataaaaaaatccacaggaggggaggagaaaataagagagcgaacaagatgtaattatgtaaagacaacgacagcccaccacaaaaacggagggagaaaacaataaaaacaacaccagcagcggcgcgcggccagcctaaaaccactcagacgtgatagtatcaagacaaaacatcgtcagaatgaagagaactactgcagagaaagagcacacgaccattctatctggtgagaagacgacatatagagggcagcaccacaacaatacacaaagtagaacccactacaaagtaaagaaaaacaataaaaaagaagttaatgatagaacaaaacaacgatacataacgtagccgggaaacaacgtacaacagcaatgagtgagcaacaaactatacacggcg

SEQ ID NO: 53033 - DNA, 4796 bp, Homo sapiens
taacaacagtctgagaaggcactttgattgctgtattgcagatgataagcagcttgccgaagatcacccagaactagttagtaacagagtcaggattttgacctaagctctctgactcttactcactgtgtctttttctttactccatgctttagagagaaaaagtaaatttcgatagtaagatctgctgcttttgtgcgattctgcttttttaaattatggtttttttttttttttgttatgtcttgattcaggataacttggccaagtcctgtgacttttacttatttttatttactttttctttctttctttttttctttctttaagtggtgatggagcttctgtgtggaagagtttggtgctttgaagcctagagcctgcttattccctctggtcactctttgccccatttcctatagacttacccctgtccccaaacacagcaccaaacaccccattatcaagatcaattcacatgacctctgagacactgcccagagctcactggagcacagtctgactagcctagtctttgtaaaggcagaaggacatgtggggcatgatggggtggggtgggcaatttgtaagcttcactgattctgtggggtggcattttttttctacaggaacaaagtgttgctttcaattgactgtttatgggatatataacaggactttactctggaaggcccgttccagactggagacaatgttcttactttgtttcttagaaggcgggggtagggggagacttgtttctgaggaattttttggttctcttgttgctgatccttccatgattagggacattagttacattgcttcagacttacggagagttgctcaaaatggttcagaattgtggttgctcatcagctgttcctttcagaagcattttggctgaaaatagaggttggggtagatgtttcaccaatgttgtacccatctttgaaatgtgttttgatgtttgatgaacaaagaaaaaccttataatttgatagggtaaaggtagttagaatgccacactgggacttttagtagaaggaacttttagacagtggaaaagaatctgttaatcttcaacatacgtaatgctgatcatgcttaggtagttttacacggatattctgattattaggctatttttagtgaattgttgttggcctttgctagcagttgtttctttgataaaatttcaagatcagtggtggttcagttaaagaatagtctatgtactccatacagttactaagggctgatcatcattatcaccatctgcaccgccatttattgatgctaaacttatactaggcaccaataattgttagctgatgatttttcattattagttgataatgagccttaacacataactgggtctgtcttctagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggca

SEQ ID NO: 53034 - DNA, 5510 bp, Homo sapiens
gtatccccatttgttggagtctgggtcaagtaaggaggttttttgggttcaatggtggcaggtccctcatgaatggctgggttctgtccctggtggtaatgaggtgagtttcttattccagttagctcatgttagagctggttttgaaaagagtctagtgtctttctcacctgttctcgttgctccctttgtggccatgtgatatgcctgctcctcctcttcgccttcgcaccatgattgtaagcttctgttttctgtgtctgtgcggtctgtctgtgtgtttttgagatagagtatcactctgttgcccaggctggagtacagtggtgtgatctcagctcacagcaacctctgcctcccaagttccaagtgatcctcttgcctcagcctcctgagtagcagggactccagacacatgccaccatgcccagctaatttttgtatttttagtagagatggggtttcaccatgttggccagcctggtctcgaactcctgacctcaaatgatccatctgtctccgcctcccgaagtgctggcattacaggcatgagccaccgcacgcggccaattgtaaacttcttgaggttgtcaccagaagcagatgctggcatcatgcttcttgtacagcctagaaaggcctgtctgtctagattcttcttggcatctctgagcatggatttcattctggatatggggcaggatgctctctggaatgagggtctttagacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaatggtggtcaaagtaattattcctttttcctctcccatttacagcatgctgactttttgaaatcttttcatagaaaaattaaattactttatctggagttacaccttttcctattttcaaacagtgtatttttctcaaagaaatgactgcatgtcgtcatattcttcatgctccagtaaaacttttatcagacaatatgatctatgtttaaccatgaggagagaaaaagtgatcttcatttttacatttgctatatggacattttcttttaattggctaggaaaaatttgttctacatggtccatatatatccagagtacccacacgtgaacatttactgctagaatggaaagaaggtatggaacttagtctgggactaaatgttcagtgatcttctgacacctgaaggcgcaatgacttacactgacatacgtgctatttctagagagggcatgactattttggagaaagcagctttgggctgagtggcgagtagctttacctactctaaaataagttcttaaggtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggca

SEQ ID NO: 53035 - DNA, 3520 bp, Homo sapiens
taacaacagtctgagaaggcactttgattgctgtattgcagatgataagcagcttgccgaagatcacccagaactagttagtaacagagtcaggattttgacctaagctctctgactcttactcactgtgtctttttctttactccatgctttagagagaaaaagtaaatttcgatagtaagatctgctgcttttgtgcgattctgcttttttaaattatggtttttttttttttttgttatgtcttgattcaggataacttggccaagtcctgtgacttttacttatttttatttactttttctttctttctttttttctttctttaagtggtgatggagcttctgtgtggaagagtttggtgctttgaagcctagagcctgcttattccctctggtcactctttgccccatttcctatagacttacccctgtccccaaacacagcaccaaacaccccattatcaagatcaattcacatgacctctgagacactgcccagagctcactggagcacagtctgactagcctagtctttgtaaaggcagaaggacatgtggggcatgatggggtggggtgggcaatttgtaagcttcactgattctgtggggtggcattttttttctacaggaacaaagtgttgctttcaattgactgtttatgggatatataacaggactttactctggaaggcccgttccagactggagacaatgttcttactttgtttcttagaaggcgggggtagggggagacttgtttctgaggaattttttggttctcttgttgctgatccttccatgattagggacattagttacattgcttcagacttacggagagttgctcaaaatggttcagaattgtggttgctcatcagctgttcctttcagaagcattttggctgaaaatagaggttggggtagatgtttcaccaatgttgtacccatctttgaaatgtgttttgatgtttgatgaacaaagaaaaaccttataatttgatagggtaaaggtagttagaatgccacactgggacttttagtagaaggaacttttagacagtggaaaagaatctgttaatcttcaacatacgtaatgctgatcatgcttaggtagttttacacggatattctgattattaggctatttttagtgaattgttgttggcctttgctagcagttgtttctttgataaaatttcaagatcagtggtggttcagttaaagaatagtctatgtactccatacagttactaagggctgatcatcattatcaccatctgcaccgccatttattgatgctaaacttatactaggcaccaataattgttagctgatgatttttcattattagttgataatgagccttaacacataactgggtctgtcttctagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattgattggtaagcacttgtgggcttctgccttcatgtgaactccagtttctcaatatatatttctaaggtccatattgatgaaataattaaattttgttcatggaagttgcttcagttaatattattttggtgaaaattcattccagttggtgtaattctcattcaaatacattttagaacactgaataaatgcatcaactgagtcaaaatatcctatactcaattcttatcttcctttactgactgtgtcccgttagctgataatggaatgggggattggaatccttatgtatgtactatacataagctaacttttgttctgctgggtataaataacagccaaagattctgcttcatagacctgttaaaaatgaaaaaaaaaaaaaaaaacatgtgccagcagaaaaactactgttttaattttattcagttgtttgctggattgttaaattttcaggaatttttaggctgggcatggtggctcagactgtaatcccagcactttgggaggctgatgtgggtggatcacttgaggccaggagtttgaaactggcctggccaacatggtgaaaccccgtcgctattaaatatacaaaaattagttgggcatggtggcgtacaactgtaatcccagcttcttgggtggctgaagcatgataatcgcttgaacctgggatgtggaggttgcagtgagctgtgatcatgctgctgcactccagcctgggtgacaaagcgagactctgtctcaaaaaaaaaa

SEQ ID NO: 53036 - DNA, 1030 bp, Homo sapiens
aggcttggaagagaagttgagtgacttcagcaaggtcacacagcaaggaggtgatgctgacaagactccaactgagggctggttccagagcctgtattctttgcattgcactacacaacttcaaaacattcctacattcagaagtctggtagaagaaaaaagaatgaaatacaaatattccaaacataaggcagtatgagatcaatgccatatgagatctattaagagaagcactatgtgggtgaaatagagagaagggttatttctggtcagagcaattaaggaaggaatcccagaaacgttgggctttaccagaaaggtgagatttctttctttcttttctttttttttttttttttttgagatggagtttcactcttgttgcccaggctggagtgcaagggcacgatctcggctcacagcaacctccaactcctgggttccagccattctcctgcctcagcctcccaagtagctgggattacgggcaagtgccaccaccctcagctaattctacattgtaagtagagacagcgtttcaccatgttggtcaggctggtctcgaactcccgacctcaggtgatccactgcccccagcagaaggatgagatttcaataggtgaagatacgggactgcgcagcgaaaaaggggcatttcatgagcaacacgtagaacttagactctggcgacaaccaaggttcctattccattattcaccagctgcagaccctggagaaataactgaatgtcctacacctcacttttttcatcagtaaaatgggatactagtaacatctttttcctaaagttggagtaaggattatggaataatctatataaagtatttagcataatgcttagtaagtggtaaacatccaacagacagcaaatgttagctagtagtctatgtgtttaaagaatggtaagcagtcaagttaggcttccagtcctcttaaagcaaaataagaaatgtggtcgaaacaataggttgcagtcagattgagaatgaagttcatgtctaccttagaa

SEQ ID NO: 53037 - DNA, 286 bp, Homo sapiens
aaaatgttttgagaagtactggttgctataagagcatgtaatttaggccctgtcctagtttaagaggtcagtgaagtctttcttaaggaaatcatttttagctgaaatctgaaggatgagtaggaatttatgaggggacaacagggaatgttccacgagtaggaacagaaaacagttctctaactcagtattttagtcatattggtcttctttcagttacagttgtgtgctgctcagtgacactttgatctagggcagactgcatgtttgatggtggtcccacaag

SEQ ID NO: 53038 - DNA, 300 bp, Homo sapiens
accatgcccagctcattttgttcttttttaatgctattacaaatggaatattttaattcaaatttcaattttttcctaatgtattgaaataagaatttgtgcattaatatgcgatcgactttcgtgtcttgatcttgcatcctgcaaacttgctgaattgtttattagttctaacagtaattttacatattccttaaagtattctatacacaagatcatgttatgaaatattcctgatactgcggagaaagttttcttttttttttaacctgactcctaatttatttttttacttttttt

SEQ ID NO: 53039 - DNA, 190 bp, Homo sapiens
atcccccaggccggtcactgcccccacccccattccttccatccacttcttcacaccttaattacctcctgcctgccgggaggggacaaggatttccagccctggggcacgtgagcattctagattcacctgcaccctctgttcgcccatccccagattcagggactggtcaggcgtccccaactccctc

SEQ ID NO: 53040 - DNA, 2562 bp, Homo sapiens
cacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctga

SEQ ID NO: 53041 - DNA, 2666 bp, Homo sapiens
cacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctgaaaaaaaacaaatacaaaaaggggcgcctaaaattcccggggggcaaatcgcatcccctttgaaaggccacacgaggaaaaaaaagggggggttaaatcgcgaaa

SEQ ID NO: 53042 - DNA, 2420 bp, Homo sapiens
cacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctga

SEQ ID NO: 53043 - DNA, 2388 bp, Homo sapiens
gtatatatgtgattaagatatgtatttctgacttgaagtgaaatattctggaaaactcacacaactatggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctga

SEQ ID NO: 53044 - DNA, 1898 bp, Homo sapiens
cacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctga

SEQ ID NO: 53045 - DNA, 2086 bp, Homo sapiens
aattaatcataaatgatctgtgtgtgatcgttatctcctataaccgtccaacttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctga

SEQ ID NO: 53046 - DNA, 796 bp, Homo sapiens
ctagaggatcgtccctaagccaacacacacattctccactaagtagacaagtcttagggtttccttctttcccttacaaataatgtacaaatttagaagtagctggtaaaactgatagatatatataagatggcaaataaaaggtgacattttctgttggttccgaaactgttcctgcaaattttgtcctttgctgtgttctttaaccgtatgtgttacatgcagaaagctcttttcataagaattgacaacaaactcgatgtaagttacatttacagtactgtataaagttattcagattcacggacaaatgtggaaaaatattaacaggtggtggtatagctgataccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctga

SEQ ID NO: 53047 - DNA, 2040 bp, Homo sapiens
cacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctga

SEQ ID NO: 53048 - DNA, 2508 bp, Homo sapiens
cacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagtctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctga

SEQ ID NO: 53049 - DNA, 842 bp, Homo sapiens
cacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagtctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgactgtctgctccccgttggtccaaggccaggatattggggctgctttagtccttcagaatttccagggaaagcccttcggaaattgcgccggaaggtagattggcacct

SEQ ID NO: 53050 - DNA, 472 bp, Homo sapiens
gtgaccttctatggaaggaagccctgcagagaagcagcctgggaaatgttcacctctcttctcttcggtccccttccatggctccccactggtcagaccgacagaagtcagaaggagtcagggcctgtgatggggtccaggctggtcagcttccttgggcaggaacagggtgaagacagagtggatctgagaggggagtggaggagacccagccggccctccatcacagctggtctccactcgagcattccaggaatgtcaggtggatgggatctggcccggagctgacattttattcgggcaacctatgggagatggatttgccagtggtcgggagacaccacatcatccggccccagctctgactccgctcacgccttggaatgtctttagtcatttaaattcatttgcctggaactggcattgtttctccagtaagatggcaaataacaaacttcatttagtcttggct

SEQ ID NO: 53051 - DNA, 335 bp, Homo sapiens
ccggggtagggggccattgaattgggagtgctgattggttggctcagagataaaatcacagggagttgaagctgttcttttatgctgagtcagttcctgagtggaggccacagaactagttggcaggtccaggtggggtcattcggttgttagaaatggaaaaaccttatttattagggttctctatagggacagaactttatataaatataatatttatatttatatattatatatataatatttatatagttatataacatatattatatatatatatatatatatatatgtaaaggagaattttttaagtattaacttacatgatcacaagg

SEQ ID NO: 53052 - DNA, 260 bp, Homo sapiens
  misc_feature (144)..(144): n is a, c, g, or t
  misc_feature (162)..(162): n is a, c, g, or t
  misc_feature (228)..(228): n is a, c, g, or t
  misc_feature (235)..(235): n is a, c, g, or t
cacagaacccctaaaatcacactcgattgacagttgcaactgaaaagcacacccagtccaaagccgcaatggttgttatcacgctgcttccataaagtgagattcagcccccaaagatgggtctataagtttggatggcctttnctctttctccttttactngcatagcttttagaattggtgccacaattacagctttaactgggtgaagatagattgaagggtagntagatgntatataaaagacaggcctccttcct

SEQ ID NO: 53053 - DNA, 354 bp, Homo sapiens
tatctagtatattattctggaggtgaggcaagtatttaataatgatgttttgaaaagtaaagtaatcgcaaaagtaatcaatttaactctctccatttgaagtcttaatcttcagctatatggaaaattcagatattcagaaagatacttcttttctctgaggattccagagaataaaagtttacttgataataacaaataagttgatttttaggcaatcacatgtattaattccaaaataatttttttacattgaagatttagcctggagaaaagaagtttagaactcttttaataagtgaaaatatgcagaggaaacagagctgcagctaattcccacctgcattcagaaag

SEQ ID NO: 53054 - DNA, 306 bp, Homo sapiens
aacccttcagtttccttacaggctttcgagtgcacatgagaatgcacactggagagaaaccttataaatgtaaggattgtggcaacgccttcatttggcgtgcatccttacaataccatgtgaagaaagtgcacgctgaatagaaactataaatgtaaatatcgaaagtttttcaattttaacgattttcaaagttgatatgaaagttcatactggagggtagttgcatgaatgtaagtaatacaggaaagcctgatataacttaattcaggtagaatgctctagaaaattcatgccatgaaaaaa

SEQ ID NO: 53055 - DNA, 243 bp, Homo sapiens
agggaccagcagagactgttcacaaaatgaccccgaagaaaacgtcacacttcatgtattttcaaacccatgaagaatagttatgaatcaaagctgagtcttaaatctcatttcaattccaactttcctcctaccaaaggaaaggaggcatattgttaagttcaaaagacccaaacaagatatcaaaaagttgcctgtgagcaccaaaaaaaagatatttcatataatttatctgcaaatacc

SEQ ID NO: 53056 - DNA, 439 bp, Homo sapiens
aaaatgagtatagaatacatacagcaaagtgtatctagtaggctaatattaaatgcatagtgatacatttttgcataggtttgcacccatgggacccctactgggatcatggagaaggtgtctgattcactttatgagaaactgccaacaaactcaaagtgagatagtactttatccttactaggatggttacaattaaaaggacacggtcagtgttggaggggatgtggaaaaatcagaaccttcgcgcactgctggtgggaatgtgaaatggtttgcttgctttagaaaacagtctggcagtttcttttgggggtgatggttgcacaactctgtaaatttactaaaaaccattgaattatatactttaaatgagtgaattttgtggcatgtaacttatatctcattaaaggtgttaaaatcctgccaaaccattttc

SEQ ID NO: 53057 - DNA, 985 bp, Homo sapiens
gtactttgtgatggaactcccctgcctggagatggcaggattaaagttcctctttgtctgtctaccattgacaagagtgaaatcatggcacagaaagagttgggaagactcagatttgagctgcagagacgtgacttttcgagcaagttactgaacctgtctgagaatcattatctctgtgtgagcacgagagtttttgtgaaagtagaaacgctgtgtattaagtacctgaacatactcagtaacttgtaacaattataagtctttaaacaacctttctgccttataatgctttgggaatcaatttcaggatgatttttaggggaaaaaggaaattctaatttgtagcagaaccaactttggcatacctgggggaaatggtggtatagtaataatttgaaacatttttgagcattggtcactgtataattaaaaacaaaccgctgttgctgaaactattttgtctgttagtaaagtgactgattttagatagcatttcattagttctaagtgttcttttaaaaaagcctgcttctatttctggtaacatggaggattagaagtgcctactgataatagttcagctaaacgtgctacatgatatgttacacacacacttgtgtatactgtatcttaaattatatatacacatcttgaaacacatttaagtgtttttagtaaatagtttagctggtgggagagtaaagggatttttctgaggcctgcgtcagttagtgctgtagatccagtgtggtccttgaaagtatctgccggttcctggtggcatagacactgagttttgataggcagtgaacatggggcacagatataaaggctgaggccggggaagaggacataaaagacatgtggataatgtgagaactcccgaagagtggcagcatcctccccgtgggagctattaaaaagaattcttaaacacaggaccacactcacactggtctggagcaagaattcatactatttg

SEQ ID NO: 53058 - DNA, 782 bp, Homo sapiens
agcggtaacgagggtgggggaaccggcaggatgactttgagaaaaagcaaggcacagcatgggtttgcaggccaggcggacctgggtttgaatcctagtcctgctactcagttgctttgcagcaataggccagttactaaacttccttatgcttctgtctccccatctgtaaaatgggctaatgcccacctctcaggattaagtgagaggctgtacctagagtgcatggcaggtgggaggcatttgggaagtatgcgctgggagaccgggggtctctaaagatggagatatttgggcttgagccccttcctgccacctttcctcctatctctgcctctgctcgctgctccaaaccctgtttctttactcccaggtagctgacactgagaagctatcagagatacaggcaaaagattagttgggaaacttttctggaaaactagtctatcttctcttgagttcctgtctcaacatatatgtgcccccttgttccactgactgaacggataagccctcctgtgggtgggctttcttgtcatctggtccacctttctcttagagaggacccctgcctccctcacttcagtccgttcgcagcacagtggggagaaggatggctttgggatcaggcaaaatccaagcctggccacttagtcgttgaacgtcatttcacctctctaagcctcagtttccttatctgcaaaatggaccaattgtgactagataatgagagaagccatgtaacagtatagttccaattgccagtccatgaacgagtgctg

SEQ ID NO: 53059 - DNA, 538 bp, Homo sapiens
gtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagagaaactgcagcgcaggattttaattttgggaaaactaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaaaaaaaaaaaaaaaaaaa

SEQ ID NO: 53060 - DNA, 1255 bp, Homo sapiens
ggtgttctctgtttttgctacttgtgggttttactgtcttgcgttcgtcagtgtttagtgctgttctagatttatgttgcatcgttagtcaggcgcatgggctgtcagtgttgtcgttcgggctttatctcatcctttgtgtgcaggagcgacgagcgccaagaagcaggtgtagtgatgtatggttctatctttcatagcttattcctgtagctgatcaccattaggagtgttgtgatatgagtcggatgttggtctgtgtgcttgtttttttgaatatgagagtacagtgatttattatttgaggtctggttgtttgattagtgtgtagacagcgggagtgagtagttgtaatgttgtgaataaccgagatgctaaaagtgagctaatagcgtgttaagaatatagtctgggggttgctatcctttcgtgtggtcttgcatggctctgtgggtttacttcttccgggctcgtcaattctccagatttacatgtcatgctcgccggattacgggtggacaagccccgtggcatagcccatgaagggtctgagaaagtttgatcccgccagggctctgctggttcgcatgttcagcctgcccggcctctagggccggggtatctgtccgtccagtctcatgaagcttcaccttgtcgtagcctcccaaagccgttgagcactaggcagcgcagctagtggcagacgaagacagacggtcaggtcgtcggcacccattcggacgtcctcgggtatctctggtgttcgctctgctgcctcgtttttcgggagtcgccgaagaggcgtcgtccccggtcgctgcctcggctaccgctgctctcgtcggacatggctgggactcccgtacgagagcgcacagctggatggagagtgcacagctggggaaggcggaacgcgtcggcctcgtgccgaattcggcacgaggccattgtctatgaattggaataccagtcggcaggttcagctccatgatagcctcttcagagagaccctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcctctgcagctacaactcaagatgtctacagatgtggtcagtgtgaca

SEQ ID NO: 53061 - DNA, 835 bp, Homo sapiens
tcacactgaccacatctgtagacatgaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataaataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaaaaaaaaaaaaaaaaaaa

SEQ ID NO: 53062 - DNA, 1162 bp, Homo sapiens
tcacactgaccacatctgtagacatgaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataaataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaaaaaaaaaaaaaaaaaaaaaaaacaaaaaaaaaaaacaaaaaaaaaaatttaacagaaaaacaacaacagatggaggaaaacaaaaaaatgcgctgggcgcgcccgcgcgccgcccccagaaaaatttcttaaacaccaacgtcgtgggggggggcgccggcccccaggttaagagaaacagtgtggcccaacggtgctgccccggagaaaacaccgcgcacaacatgggcgcgggggttctcccccccaaaagaaagagcgcgcggggcacagcgggtttctgaaaccccacgagggtccgcgggcagcagggggtcacacaggagaccacgagggagaaatag

SEQ ID NO: 53063 - DNA, 901 bp, Homo sapiens
cagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcctctgcagctacaactcaagatgtctacagatgtggtcagtgtgaca

SEQ ID NO: 53064 - DNA, 988 bp, Homo sapiens
cagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgccctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaaaaaaaaaaaaaaaaaaa

SEQ ID NO: 53065 - DNA, 507 bp, Homo sapiens
cccctgcccatacctccagattaccccttcttctgagggatcaaggtagtactgtaccttgctcctcaggggcataatcaccactacaacgtggcaccttgaacccaagctgctagggggtgcctcagagtcacaaatcttggcttcatgggaaacctacatctaatcctgccaaggagagcaaacttgcacctcaagacccaggtgccataacagtgcaaggccaagatgaaaggtttccacagcagagaacaagaaatgaattatctcattcaaggatgagaggagaacataatttatcttggatgaactactgtgctagagagctaagaaggaatgaagtgaagattttcaaacccctgagggagggctgtgcattgcctgaatgaagaaccaacttggaaaatgtatctctgagcaagggctggaatagaataacgttaggacagagaaaaaagttctgaggcagatcacccctgcactgtgagaggtactggtttctgaagt

SEQ ID NO: 53066 - DNA, 243 bp, Homo sapiens
aaaaaataagaaaaaaagagaaggaaacaaagtcataaacatattgctgttgcctcaggttgcatgtcatgtttgttcccaggcctctcgtgaccattctggctcaggctgtgaacagcctcagaggagtctgaaatcccaaaaggatagtgatatttaaagtcagtaatcctctaacagaatctctctcagagactatgccaagcctccataccatcagcattttctctctgtatatataca

SEQ ID NO: 53067 - DNA, 1108 bp, Homo sapiens
tacgcttgaatattgatgggaaaaaagctgccaacttataggtgctcaacaagcatttgttaaggtacagttttgaccttggagtttcatttcagtccccgttgtccccagcttggctatgtgaagggcaccctgaccctggactaaagagagacagccctgccttctgattcttaatggcatttggtctcatgcacttccaaggattgtgcctggtgacaccccccaaaaaagtatttgaattctccaaagacagactatagaccacaccgtttgtcccctaagttattaaccaatcatgtgaatataaaccaacaaatttctgatacttctgattctctcttaattgggatgatatttgaataaataacttccagtgtacattcagtgaaataggttcctaagtattgggcttacaatacacattcacagaattccccgggtcttaaacttttatattccaatcaatcctaacctttttttttaagctacactttaatatcagtttattgcttcttattaaaattaataataataataataataaaatttactctttgatcttactgttacataatatgctcactgaataataagtagaggatacagataagcaacaaagataataaaggtttttgaaatccaccagagatactatttcctgccaatgtctacatctatgtaaatatatatttgttgtatctttaaattttaaatttttcagtattttattgccatattcttacaaaagtcatttaaatattacatcttcattgtacacaaattagacaataaagatttaagaaaacatttgttgagcatctgtacctgacctagtagagatttccaaggccatatgctggtgcatatcttctcagcatttaagatatctaaaaccggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcatgaacctggga

SEQ ID NO: 53068 - DNA, 188 bp, Homo sapiens
  misc_feature (7)..(7): n is a, c, g, or t
tgagganacccatcctgccacccacagcaccctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53069 - DNA, 360 bp, Homo sapiens
gcggccgcctactactactactactgctcgaattcaagcttctaacgatgtacggggacagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53070 - DNA, 205 bp, Homo sapiens
ctgacagttcttcaggcatttctatttcacaatcgaattgaacacatcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53071 - DNA, 209 bp, Homo sapiens
  misc_feature (7)..(7): n is a, c, g, or t
tgagganacccatcctgccacccacagcaccctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccaccagtaaaaaaatttctttttgt

SEQ ID NO: 53072 - DNA, 935 bp, Homo sapiens
ggaacgcgtgggcggacgcgtgggtgtgcctggacttcatgctggggctgttgtccctgccgagatgtggaccctctgtagactccatggtgccaagctgggagacacacatacgccttccatgcccagtggaagggtccaaggctgagctgggattcccagggttcctgacacagtgggggctctgattcatcctgctataggcagaaatcccccaggcgtcactcttcctgggaagacccctgtgtagctcgtaaagaccagggttggctgctccagtggccggtggccattgttccgccgtggccggctagtccccggtgtgagcagtgtggggtgctgggggccggcagcctcagctgttgcagccaacctgcccgccccgccccttttcctgtatcccagggatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctcaccaagacccttgcttcctgcttctgccagaactatcacttcttgtcaggactgagattccactgaagctgctggctttggttacagcaggtttcaggtttcgaagagagctgtctgaatctgtgctgctc

SEQ ID NO: 53073 - DNA, 977 bp, Homo sapiens
ttagtctaggtacgaggctgggttgcgcatgaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaagacgtggagtcggactctgccaagcagcttcttcgccaggcagccagcaggcccatcgcatgcacactaccaactttgcgcgacccacctttcccaaccaaggtgcacgctgcttcctcccaaccactacacagacatcgcacccaaacgcatgcgcggctcaggtcccctcctttcttcaacgcaaacgcttcttgcacgtgcacacggcggcccgggccaacccaccccctttccgcacaagcggcgaagcagacggttccgaccccacacggggctaccgacagcccggttggccattgtggcaaccgttagtcgcacgtccggagacatcatctcacgccaacagcctccgaacgcacccgttggccccgccacaggtcattgagcttccaaagtcccgagccaaagggacatgaccaagacgccagagacagcggtgccggcgtggttaacccaacgcgccggctccgccagggcgcactcaagtcccaagatactcgcgcgacacagggccgtcacaacgcgcggattttcgcacaacagaaacttatccgcacgaaactcagcacacccagttccgcgaaaccgcgcaacgtttgaccccagctctgggccgcgcaatggggccgccaacaacccgcgttcatcggcacccccagcccgccaaaaacgggccaaacggccctcggacctacgcgcttccccacgcacgcggaacacccattcccagtatgcgcaaaccacaagcatgacccaccacccccacacaccccgcaccggaccacaccgcacccatcacca

SEQ ID NO: 53074 - DNA, 719 bp, Homo sapiens
actcctagaggatcccagatcccctttccatccggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacgacggtgcgccttccctccagacggggctggggcgggctctgggaagagcagtggtccccacgccagcctgggtgcctctctggaaggagcctggggctagtcaggtgggagaagagctgtgggagctccttcagaagcacccacctttgtttttcgagagagatgggatctcactatattgcctaggctgtttttgaactcccaatgtgctggattccgggtgtgagccaccggaccgggcctgctctgcctttctctagggaggaggagccaatgccaggagattggctctgggccgggaccagcccctgcactcatc

SEQ ID NO: 53075 - DNA, 352 bp, Homo sapiens
ggctgctgtgacttcccacgtccagggagacccgggcccaggggctgtgctcccagcagcaatgctcagtcagggccctctttctgtccacatttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagaggtgagctgctcttctgggtggctcgtg

SEQ ID NO: 53076 - DNA, 780 bp, Homo sapiens
  misc_feature (26)..(26): n is a, c, g, or t
aaggctaggtacgaggccgggtgttnagccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagttggtgacggccgacacactttgaggcgaggtctccagggaaactggtggctatcaaaccaacagtgccctgctcagtacgagaaagccaaatt

SEQ ID NO: 53077 - DNA, 778 bp, Homo sapiens
  misc_feature (765)..(765): n is a, c, g, or t
tatggctagtgggctggggtttatcggccgaggcgctgtcccggggtgcagccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtgaaggccggaacaactttgaaggagaggggaggagaggggctttcaaaggggatngtgtagagcgacc

SEQ ID NO: 53078 - DNA, 2445 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53079 - DNA, 2882 bp, Homo sapiens
  misc_feature (2585)..(2585): n is a, c, g, or t
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccaccaaaaaaaaaaaaaaaaaaaaaaaaaaaaaaaagggggggggggggaaaaaaaaccccgggggggcccattgccccccctttttttggaaaagggcgggccaaagagaggggggttaaaagcacaagaggcgcgcggggtnaacaacggggcgggggcaacacgccggcgcggtagtttggagagacccgctctgtgcgcggtgggccacattgtgggccgcccccagagatttacgagcaggaaaaaacgcggttaggtggaacgcggccatgctgtgctgtagtttgtctggatttataagcatcgctctcgtacagatacagcaagaaaccccgcacagaggatacgcaataagaagaagtacgtagtcaacggcaacgcgagaccgctgtcgaactaacgactggatacaagcactagtctaggcacgactgtg

SEQ ID NO: 53080 - DNA, 2888 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccaccaaaaaaaaaaaaaaaaaaaaaaaaaaaaaaaaggggggggcgaaaaaaatccccccgggggcccaaggctgttccgcgggaatccccggcttttttgtggccaaatgggtggccccttaatggaggagccagggatttaataataagcgaaagggacacggtgcccgctgttttaaccacgtcggtggagttggggcacaagcccggctaccgctggcggcatctgtgtggtcagagaagggaccccttaccttcgcggtgggggggcggaccatcatggggcgacagaactcaccctaagagaagaatcaagaggcccagaggggcaattttacacctctttggagcggtctttaggggtgttaaccactacggggataaatgcctgcggctctgaaaacttttggcaacgggcagtatgcttgtcgacattcttttcgggt

SEQ ID NO: 53081 - DNA, 2859 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagagagaggggggggggcgcgccgcggcgcccccccccgcggcggggggcccccagaaagcgagtgccgccgcacaaccggcactgttgtatagaaaagaagggggacgcgccgcgacacgaagaggaggggcggcgacataatcttacggagagcgggacgggggtggggccatcaacaaacacaacgccgcgagggagaggaggagacagaccagcgctcaggcgacaagccctggcgcgggggaggacaccaccactactctggggggggggtggaggcaccagcgggcacgacagctaagat

SEQ ID NO: 53082 - DNA, 2461 bp, Homo sapiens
  misc_feature (2417)..(2417): n is a, c, g, or t
  misc_feature (2423)..(2423): n is a, c, g, or t
  misc_feature (2433)..(2433): n is a, c, g, or t
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacataanccacantgccaataantattcgggtctttgctggtctgtgtagg

SEQ ID NO: 53083 - DNA, 2452 bp, Homo sapiens
  misc_feature (2452)..(2452): n is a, c, g, or t
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacactatcacgagggtactaactcgagtcgtatcatgtcatn

SEQ ID NO: 53084 - DNA, 2385 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53085 - DNA, 1810 bp, Homo sapiens
gatctagaggatgctttaccaggacagatcgacaagatggggtgttctctttaagatttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53086 - DNA, 2572 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctgtaagtgttgccctttcagctccccaggtccgtgcaccagggcacgcgcaaggtaggcagactcctggggaagcgtctgccagtggctttgtgtccaggacacaccctagaactgctttcttttcagatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53087 - DNA, 2274 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcagatgcctgggcacctacttcacactccccggaatttccgccgatact

SEQ ID NO: 53088 - DNA, 2242 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacagatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53089 - DNA, 2734 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccaccaaaaaaaaaaaaaaaaaaaaaaaaaaaaaaaaggggggggcgaaaaaaatccccccgggggcccaaggctgttccgcgggaatccccggcttttttgtggccaaatgggtggccccttaatggaggagccagggatttaataataagcgaaagggacacggtgcccgctgttttaaccacgtcggtggagttggggcacaagcccggctaccgctggcggcatctgtgtggtcagagaagggaccccttaccttcgcggtgggggggcggaccatcatggggcgacagaactcaccctaagagaagaatcaagaggcccagaggggcaattttacacctctttggagcggtctttaggggtgttaaccactacggggataaatgcctgcggctctgaaaacttttggcaacgggcagtatgcttgtcgacattcttttcgggt

SEQ ID NO: 53090 - DNA, 2092 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttccaaggatgctggagctgaatcagacgctgacagttcttcaggcatttctatttcacaatcgaattgaacacattggccaaataaagttgaaattttaccacc

SEQ ID NO: 53091 - DNA, 2556 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaaatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctgtaagtgttgccctttcagctccccaggtccgtgcaccagggcacgcgcaaggtaggcagactcctggggaagcgtctgccagtggctttgtgtccaggacacaccctagaactgctttcttttcagatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacgacgggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53092 - DNA, 1984 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53093 - DNA, 1758 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53094 - DNA, 1652 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacatcccgaacggacctgggacataacgccgaggagcacagactggatggaatcacccatgacccaacgtcgggatacagtgagccggctatacacaaggccacacggcgcgagcaaacccgggggggacccacacagcgc

SEQ ID NO: 53095 - DNA, 1745 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacgacggtgcgccttccctccagacggggctggggcgggctctgggaagagcagtggtccccacgccagcctgggtgcctctctggaaggagcctggggctagtcaggtgggagaagagctgtgggagctccttcagaagcacccacctttgtttttcgagagagatgggatctcactatattgcctaggctgtttttgaactcccaatgtgctggattccgggtgtgagccaccggaccgggcctgctctgcctttctctagggaggaggagccaatgccaggagattggctctgggccgggaccagcccctgcactcatc

SEQ ID NO: 53096 - DNA, 1473 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacgacggcattgattacaacggggaacgcacgctgtggaaagggggatct

SEQ ID NO: 53097 - DNA, 1332 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctcactattcctcttccacttgcagatctcaccatgtttattgttgtttccggtcatccacttatgtgcagtcctgagttcgcactgaga

SEQ ID NO: 53098 - DNA, 1198 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53099 - DNA, 992 bp, Homo sapiens
  misc_feature (925)..(925): n is a, c, g, or t
  misc_feature (927)..(927): n is a, c, g, or t
  misc_feature (930)..(930): n is a, c, g, or t
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagggnanttnagggagatctgtcactcatcgaaggcccccgaacgggtcccagtctggctaaagaaatgcgg

SEQ ID NO: 53100 - DNA, 969 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagcatcctgttcatcttcatcgactgcttggattaaaggaggccgagca

SEQ ID NO: 53101 - DNA, 831 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggatgctggagctgaatcagacgctgacagttcttcaggcatttctatttcacaatcgaattgaacacattggccaaataaagttgaaattttaccacc

SEQ ID NO: 53102 - DNA, 760 bp, Homo sapiens
  misc_feature (747)..(747): n is a, c, g, or t
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtgaaggccggaacaactttgaaggagaggggaggagaggggctttcaaaggggatngtgtagagcgacc

SEQ ID NO: 53103 - DNA, 978 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggtgtggctgtggcactgcccttgaactgtctttagagagggactggcctgccgacttggaagggcaggggcagctgtctgagcggtggggaggccgggttccagaggcttggagggatcccgttcctcaggccgggttctctgtccacttgtgccctgagggtcttgtgaggagttttcatcctggaagaaccttcgaatggagaacctgtcttgtctggtgccatcctgggggcggctggctgaggtctgtttggagactgaccagcgaggagagggagactggtgcctttctggccacatgggctgtttgtgctgccccctgttcctaggagcagcagcatggctgtagctctcggggtgacacctgctagctgtcgtgtgtagcgtgccagctgccgcgtcacgtgcttgcgtgatttctcctcgcatcctctctgtgaggcgggcttttcccagacaaagggctgaggcttagagcagctgagtaacagcatcgagcctgtcggtagcagacctcgaatccagcggggaacctcagagacgaccagcagcagcaa

SEQ ID NO: 53104 - DNA, 2564 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccaccaaaaaaacacacaaaaaaaaatccgggggctctattccggggggggacaaaggggtacgggatggccctggccaaactgttcctgaccctttttgtccagtggaatctggggcccttag

SEQ ID NO: 53105 - DNA, 2311 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53106 - DNA, 2425 bp, Homo sapiens
  misc_feature (2405)..(2405): n is a, c, g, or t
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcagcaatgtgctattgaaanctaaaaggggatctctagag

SEQ ID NO: 53107 - DNA, 2173 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53108 - DNA, 2329 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacgggccccagtacggcgccaaggccgctacggacgctccaacgag

SEQ ID NO: 53109 - DNA, 2361 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53110 - DNA, 2291 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53111 - DNA, 2147 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53112 - DNA, 1901 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtattaactgcttggggatcctctaaatcgc

SEQ ID NO: 53113 - DNA, 1952 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagctggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53114 - DNA, 1717 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53115 - DNA, 1490 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacgtgaatagcgaggtgccgatgaatagcgaggtgccgatgaatagcgaggtgccgatgaatagcga

SEQ ID NO: 53116 - DNA, 1460 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacgagaatggaaggggccacagtcataagtagagaag

SEQ ID NO: 53117 - DNA, 1321 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53118 - DNA, 1178 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagacctgtcatcttcatcgacaggaccacccgagagcaggcctccgagttctggcgaaaggaaagccggcggggcccatcctggggagggatgcagtcacagcgatcgaaggcgagaaaggcaagtcgcccgctggggaaaacccacgagcgggcggaggacccgtggggggaaaaaacagacggaaaagagagggacagagggagacgccgaagaacaaacacaacaagggagccccgaggggcgcgcgcacgcgga

SEQ ID NO: 53119 - DNA, 1147 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaaggttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 53120 - DNA, 761 bp, Homo sapiens
aagcaggctggtcccggtccgagtgtatggatgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaaagccgcttcgcagtaagaagccgcttcgcagt

SEQ ID NO: 53121 - DNA, 3805 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53122 - DNA, 3610 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53123 - DNA, 3749 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcgggagcctaacccagaggaagtggagactcctttactgcacatctgtctgctccaggccaggcactgttctaggagccaggatacagaggtggagacagaaacaaacaaaccgataactgtatacaatactctaacgtcagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53124 - DNA, 3486 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcgggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53125 - DNA, 2641 bp, Homo sapiens
cagtgagtcatagtagagcccggttttaatcggccgaggtgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53126 - DNA, 1914 bp, Homo sapiens
  misc_feature (37)..(37): n is a, c, g, or t
acgcgggaggacgaaccacggctaggtacgaggctgnggtgatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53127 - DNA, 1999 bp, Homo sapiens
tacccctcggttaatcggcacgaggagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53128 - DNA, 1880 bp, Homo sapiens
  misc_feature (18)..(18): n is a, c, g, or t
ccaggctggtacggcccngggatgtatggatatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53129 - DNA, 1704 bp, Homo sapiens
tacgaggcgggtgttaattcggcagaggggccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53130 - DNA, 4347 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgtatagttttctgtctcccggtctgtgctgactgtttgcggaggcctggccacgagagcgcctgcgcaggatgctgggcatgcgcacgggagtcgcccgccagggcattccatctggaaactgcgtcctccagtccgccttgtcccactatctcaaggcgctccaagagcacgagcgctgtggtcagaaaggtggggtctgaagccactgcgagcccgatcctggctctgtccccatccagctgcatgtccttaggcaaatgacctaactttcctgtgcttcagtgtcctcgtctgcaaaaggatgctcatcgcagagctcatcccggggctgcagtgaacggtaagtgactgggtacgcgcaaggggcttagaacatcacctgacgtgtgctgggcacccacgtgcccgttttgttgctgctcatccctggggagccatctggatgacttggtaaggaggcgctcaggtgagaggtcagggctgagctggtgtctttagtgtgtcagtgagtccacaggaacagacgaggtcgctccaagtgac

SEQ ID NO: 53131 - DNA, 3536 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53132 - DNA, 1267 bp, Homo sapiens
tgatgcggagatggttttatctgaggcctgagaaccaacagatgtgcctgcgccctggcctgtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53133 - DNA, 384 bp, Homo sapiens
atacgaaaaagaaggagtgtttttatttggtttggatgtgtttggtattccaatgctgcaggagcctaacccagaggaagtggagactcctttactgcacatctgtctgctccaggccaggcactgttctaggagccaggatacagaggtggagacagaaacaaacaaaccgataactgtatacaatactctaacgtcaggtggggacaagggccaaggacccagggacggagggtgatgtctgcagcagggcagtcagggagggcttcctggatgaggtggcatttgagtaaaatacagacctgtaccctgtctatgatcctatcccacttcaccccgtcagccttcccctcccacctgactctcctgcgcttctctctttag

SEQ ID NO: 53134 - DNA, 447 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcgggtgagtgactgcgcccgcggccg

SEQ ID NO: 53135 - DNA, 3920 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggaaaagcacatctcccaggatcctgagagagcttgaaccagaccactgtggacacggtggccacccgtcaccactacccttcccaaggggagacgaggagcaagtaggcttgagggaaaagctgcacaggactcgtgtcttgaaatgtctaagacgcatgtcagaaatgcaggagcctaacccagaggaagtggagactcctttactgcacatctgtctgctccaggccaggcactgttctaggagccaggatacagaggtggagacagaaacaaacaaaccgataactgtatacaatactctaacgtcagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53136 - DNA, 2643 bp, Homo sapiens
  misc_feature (37)..(37): n is a, c, g, or t
acgcgggaggacgaaccacggctaggtacgaggctgnggtgtgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgta

SEQ ID NO: 53137 - DNA, 3890 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgtaaaggggggcccggtacccaaatttcccctatagtgagtcggattaccgcgccgtacctgggccgcggtttaccaactccggggac

SEQ ID NO: 53138 - DNA, 4022 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgtaaaaaaaaaaaaaaaacaaaaaacaaccaaaaaaaaaaaaaaaacaaaaacaaaaacaaaagagaaacaaaaaatcaaaaaacaaacacccaaagtacaaacgaaacaaaggcggggggggcgccgcgctcacaccccctccgagggagacaccaccacccgcacccccgcacgccgcgtagccgacgcggcgcctccaccacgcgggcctcctagcg

SEQ ID NO: 53139 - DNA, 3689 bp, Homo sapiens
ttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcctccagcgcgcaggcgcaggacggaaaaaaaaaacacaaaaaaacaacaaaaaaaaaacccaaaaaaacacaaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaacccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgtaaccaaccctccacaccaccacacacccaaccaccaccccccccaaacacggcgcgccgccaaaattccccggagggcccaaaggcccccctttgacagggcccccgggcccaaaacacacccgccccaaacccgggacaccccgccctggagc

SEQ ID NO: 53140 - DNA, 349 bp, Homo sapiens
gaggtttaaaagaaaagatggtaagtgtcacatgtccagaacctgagcgttcccctgccatgaagggagtctttcattcaccccaggaggagaggctgtcacctgaggaagccagcatgggggagaaaggcacttgctacaaagtggggtgcacagagggtacccccccatcttcagtctcatagggaattgggccccttggccaaaagcttgcagtacctaaaaacagagaaacgtgctttgcaaaaatggctcaaagagcacaacagaatgcgctgtccatgtgcccagtgctctcaggagccctgacctattgcagaagcctgtgttgaagccgctgcactagtag

SEQ ID NO: 53141 - DNA, 428 bp, Homo sapiens
ctcactgtcgccaaggctggagtgcagtggtgcaatcttggctaacttcaacctccgcctagattagggaggatctctgacatccattagcattaactagaagtcagacgcgtcagaaggtttctatttaccctcttactcacttcttagcccctttattaagccacctcattttaaactgggcaaaacagaatcagccaaagagctttgccaggtttgggacacccattcatgaccagccagcaagagagacagtgagttcaatctgagaagagtctggtgactcccagaataaaccattccttcctggccagccgtggtggttcatgcttgtaatcccagcactttgggaggccaaggcgggtggatctcctgaagtcaggagtttgagaccagcctgaccaatatggtgaaaccccatctctact

SEQ ID NO: 53142 - DNA, 456 bp, Homo sapiens
ccaggctcgtggttacccgatggaggaaaacttctgggagaatcggctggtgagatgcctgacaccgctctcctggcatctgacatcaaggatatcttaattttcttagtttttaaaaattatggtaaatacacaaaagatgaaatttaccatctgaaatacttctacgtgtatgattctgtggcattaaatacactcacagtgttgtgcagccatcaccaccatccatctccagaactttcttcatcttgcaatctgaaactctgtgtccgctaactcccctttccgcctcccccagcccctggcagccaccattctactttctgtctctgaatttgacgactccaggtgccacatgtgagtgaaatcatacaatcatttgtctttttccaactggcttctttgacttagcgtgacgttctcaaggcccacctgtgttgtagcgtgcgtcagaac

SEQ ID NO: 53143 - DNA, 274 bp, Homo sapiens
gtaaatatatgcagaatcacgaatgattttagatacagaagtattatgactaattttgtttttttagaatgctattttaatggtatttgaagaactgaattggtaaggttaggaacctattagaggtctatttcagcaatactagcaagaaattataaggacttagactaaagcaatgttagtgagactgacaaaatgggatagatttcaaagacatttagagggaaaattaaacaggatataatttgtttaaaaattatattaacaacaataa

SEQ ID NO: 53144 - DNA, 1280 bp, Homo sapiens
gccaacgccacttatccagtgaaccaaacattcacctatcacgaaaaaaactctacctctctatactaacctccctacaaatctccttaattatagcacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53145 - DNA, 1905 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53146 - DNA, 1765 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggaggcacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53147 - DNA, 1236 bp, Homo sapiens
  misc_feature (8)..(8): n is a, c, g, or t
  misc_feature (15)..(15): n is a, c, g, or t
  misc_feature (20)..(20): n is a, c, g, or t
  misc_feature (23)..(23): n is a, c, g, or t
aatccccnttttganttccnctncctgttggcctacttgattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53148 - DNA, 1209 bp, Homo sapiens
  misc_feature (10)..(10): n is a, c, g, or t
ggatccccgngctgcaggaattcggcacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53149 - DNA, 2284 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagagaataaaatatgattgtgggccaggcagagtggctcatgcctgtaatcccagcaatttgagaagttgaggctagaggatcactggaggacaggagtttgggaccagcctgttcaacattacaagacatcatccctacaaaaatttgagaaaattatctgtacgtgatggtgggcacctgtagtcccagctacttgacaagtgaaggcaggaggatcgcctgagccagggaggttatggctgcagtgggctgactgggctaatccactcaagcctgagggacagagcaaatcttgcttgagaaataaataaaatacaatttacttaacataaattatgattcaggaccagtctggccaacatggtgaaaccccgtctctact

SEQ ID NO: 53150 - DNA, 2836 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggaggcacccacaatcagccactgcgggcgaggagggcacgaggccaggttcccaagagctcaggtgagtgacacagtggaacggcccagggcgccctcaccctgctcagcttgtggctctaacattccagaagctgaggcctctggcatccctgccctttccccatggatatcccatttcagacaaccctggcctgcgtgaatccccctcccttcccttgtttgtttgtttttttccccggggaggccaggtcttgctgtcacccaggctggagtgctgtgggatcctggccactgcagccttgaattcctgggctcaagtgattctcttgcctcagcctctggagtagctaggactacaggccctcatcatcctgcctggttaatgtttaagaatttttttaaagatttttagagatggggtcttgcaatgctgcaccaggttggtctccaactcctggcctcagcctccctagggtctgggattataggtgggagccaccctgcctaggcctgtgcttttgctgagtcatcagagttttgttcattcccacagcagctctggcccctagtagcagctcagttcctcaatgggccgtgtttgtcctggagcccagatggactgtggccaggcaagtggatcacaggcctggctggcctgggcggtttccacatgtgaggggctgaggggctcaaggaggggagcatctccactgggtggaggctgggggtcccagcaggaaatggtgagacaaagggcgctggctggcagggagacagcacaggaaggtcctagagcttcctcagtgcagctggactctcctggagaccttcacacaccctgatatctgggccttgcccgacgagggtgctttcactggtctgcaccatggcccaggccctgggattttgaacagctccgcaggtgaatgaaaggtgaggccaggctggggaaccaccgcattagagcccgacctggttttcagccccagccccgccactgagtggctttgtgagtgcgggcaagtcactcagcctccctaggcctcagtgacttccctgaaagcaagaattccactttcttgctgttgtgatggtggtaagggaacgggcctggctctggcccctgacgcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53151 - DNA, 2026 bp, Homo sapiens
ttttgagacagagtcttgttttattgcccagcctggagtgtgcagtggcctgatctcagctcattgaaacctcctcctgggctcaagtgattctcttgcctcagcctctggagtagctaggactacaggccctcatcatcctgcctggttaatgtttaagaatttttttaaagatttttagagatggggtcttgcaatgctgcaccaggttggtctccaactcctggcctcagcctccctagggtctgggattataggtgggagccaccctgcctaggcctgtgcttttgctgagtcatcagagttttgttcattcccacagcagctctggcccctagtagcagctcagttcctcaatgggccgtgtttgtcctggagcccagatggactgtggccaggcaagtggatcacaggcctggctggcctgggcggtttccacatgtgaggggctgaggggctcaaggaggggagcatctccactgggtggaggctgggggtcccagcaggaaatggtgagacaaagggcgctggctggcagggagacagcacaggaaggtcctagagcttcctcagtgcagctggactctcctggagaccttcacacaccctgatatctgggccttgcccgacgagggtgctttcactggtctgcaccatggcccaggccctgggattttgaacagctccgcaggtgaatgaaaggtgaggccaggctggggaaccaccgcattagagcccgacctggttttcagccccagccccgccactgagtggctttgtgagtgcgggcaagtcactcagcctccctaggcctcagtgacttccctgaaagcaagaattccactttcttgctgttgtgatggtggtaagggaacgggcctggctctggcccctgacgcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53152 - DNA, 1936 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcagggaacgggcctggctctggcccctgacgcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53153 - DNA, 2059 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagagaaaaaaactcgagtttttttttttttttttttttttttcattcatccatttaacatgtatttatggagtcatggttctgaactggtaggcatttgggattacagagatgagacagacggccctgcccccatggcttacagtttagcacccggccc

SEQ ID NO: 53154 - DNA, 1796 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggaggcacccacaatcagccactgcgggcgaggagggcacgaggccaggttcccaagagctcagggaacgggcctggctctggcccctgacgcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53155 - DNA, 1932 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagagaccataacacatctaccaataaataaaa

SEQ ID NO: 53156 - DNA, 2230 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaattggaggctgaggtgggaggatcatttgagcccaggagttcgagaccaacctgggcaacatagtgagattctgttaaaaaaataaaataaaataaaaccaatttttaaaaagagaataaaatatgattgtgggccaggcagagtggctcatgcctgtaatcccagcaatttgagaagttgaggctagaggatcactggaggacaggagtttgggaccagcctgttcaacattacaagacatcatccctacaaaaatttgagaaaattatctgtacgtgatggtgggcacctgtagtcccagctacttgacaagtgaaggcaggaggatcgcctgagccagggaggttatggctgcagtgggctgactgggctaatccactcaagcctgagggacagagcaaatcttgcttgagaaataaataaaatacaatttacttaacataaattatgattcaggaccagtctggccaacatggtgaaaccccgtctctact

SEQ ID NO: 53157 - DNA, 2637 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggaggcacccacaatcagccactgcgggcgaggagggcacgaggccaggttcccaagagctcaggtgagtgacacagtggaacggcccagggcgccctcaccctgctcagcttgtggctctaacattccagaagctgaggcctctggcatccctgccctttccccatggatatcccatttcagacaaccctggcctgcgtgaatccccctcccttcccttgtttgtttgtttttttccccggggaggccaggtcttgctgtcacccaggctggagtgctgtgggatcctggccactgcagccttgaattcctgggctcaagtgattctcttgcctcagcctctggagtagctaggactacaggccctcatcatcctgcctggttaatgtttaagaatttttttaaagatttttagagatggggtcttgcaatgctgcaccaggttggtctccaactcctggcctcagcctccctagggtctgggattataggtgggagccaccctgcctaggcctgtgcttttgctgagtcatcagagttttgttcattcccacagcagctctggcccctagtagcagctcagttcctcaatgggccgtgtttgtcctggagcccagatggactgtggccaggcaagtggatcacaggcctggctggcctgggcggtttccacatgtgaggggctgaggggctcaaggaggggagcatctccactgggtggaggctgggggtcccagcaggaaatggtgagacaaagggcgctggctggcagggagacagcacaggaaggtcctagagcttcctcagtgcagctggactctcctggagaccttcacacaccctgatatctgggccttgcccgacgagggtgctttcactggtctgcaccatggcccaggccctgggattttgaacagctccgcaggtgaatgaaaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53158 - DNA, 1268 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53159 - DNA, 2429 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggaggtgagaccacgtgcgatgcttccctccatgtgactcctgggggcaggcacctcacagggacccgccaaggccacccagccccctccctgggcagcccccacagcaggaccagattccccatcctgccttcttggcccaggcctccccactaaggccccacctggcagcgggccccacacagctctcatctctcgcacctgagtcagctgcatggggggccacggatcagaaacttagtcctattgctactccctgccaaagggtgtgccacccagggccacagtcacagaagaagaccatcacggtcctcacccataggagccaagcccagctcatgatgggatcacagggcagacagcaattctttttacccccgggactggggccctgggggttgaggagttggctctgcagggtttctaggagaagtggccagatcgcctctgaggttagagaaggggaccccttttacttttcctgaatcagtaatccgagcctccactgaggggccctctgctgctcagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53160 - DNA, 1134 bp, Homo sapiens
gggactgtctgcctcttgctctgatgaccaagaacgtaagactcttcagtgtagacctaagaaagctagagggtgggtcctcacaggcccacaaaatttggtggcggtgggatcacggctggtggagcatgccttgctccagattaggggtgtgacgctattgatgcagattatattactatagaatatgatggtctcagggaccaggcaggactttggcttctgagcagggttcagctcctgacttggccctaccggtgccgtgagatctcaaacaagtcagcctctaagcctcaggttcctcctttgccaatccaagagatgagctggcctgggacaggctgttgtggtgatggtgctggggttgagtcttctgcccctgcaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53161 - DNA, 1849 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53162 - DNA, 2303 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccgggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggaggtgagaccacgtgcgatgcttccctccatgtgactcctgggggcaggcacctcacagggacccgccaaggccacccagccccctccctgggcagcccccacagcaggaccagattccccatcctgccttcttggcccaggcctccccactaaggccccacctggcagcgggccccacacagctctcatctctcgcacctgagtcagctgcatggggggccacggatcagaaacttagtcctattgctactccctgccaaagggtgtgccacccagggccacagtcacagaagaagaccatcacggtcctcacccataggagccaagcccagctcatgatgggatcacagggcagacagcaattctttttacccccgggactggggccctgggggttgaggagttggctctgcagggtttctaggagaagtggccagatcgcctctgaggttagagaaggggaccccttttacttttcctgaatcagtaatccgagcctccactgaggggccctctgctgctcagaacccgaaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggcccgggacggtaggtcatgtctgtaatcccagcaatttggaggctgaggtgggaggatcatttgagcccaggagttcgagaccaacctgggcaacatagtgagattctgttaaaaaaataaaataaaataaaaccaatttttaaaaagaga

SEQ ID NO: 53163 - DNA, 1821 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagaggagaccgtggacttcatggttcagcacacgcgcccatgagtatatcaagcagaacgctagtgacacaacagcacccagccctcaagccaggaggccatcgagccaccagctattatgcgatctccactcgaggagaggaattgctggggaccggaagactcacatttcatccatagatcaatatatcagacttcaacccagcataggtcgcacaagctcgacagtccccaaggctatctcaggagcgctgatggtgcggatggagtcaggggtaccctgggtcgaggcaggcggcatgtgtagctgagatcaccccactcgcacgcgctgccactgatgacatacgcataccgtgatctcacacacacactacaaatccgcttcac

SEQ ID NO: 53164 - DNA, 1460 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtggtctatgttgcccgcaacgcaaaggatgtggcagtttcctactaccacttctaccacatggccaaggtgcaccctgagcctgggacctgggacagcttcctggagaagttcatggtcggagaagtgtcctacggatcctggtaccagcacgtgcaggagtggtgggagctgagccgcacccaccctgttctctacctcttctatgaagacatgaaggagaacccgaaaagggagattcaaaagatcctggagtttgtggggcgctccctgccagatttggggaaaacaaatttcaaacagg

SEQ ID NO: 53165 - DNA, 1619 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcagggatggagactctgaaagacacaccggccccacgactcctgaagacacacctgcccctggctctgctcccccagactctgttggatcagaaggtcaaggtgaggcagggcacagtgtttcacatccataatcccagcactttgggaggctgaggcaggcagatcacctgaggttgggagtttgagagcaccctgagcaacatagaagaaccttgtctctactaaaaatacaaaattagccgggtgtggtggcgggtgcctgtaatcccagctactccgaagcctgagacaggagaatcacttgaacccgggagaaggaggttgtggtgagccagagatcccaccattgcattccagcctgagcaacaagagcaaaactcacaaaaataaataaataaataaatatataaataaaaataaaactgtggcacctgtggtggctcactgctgtaatgccagcactttgggaggccaaattgggtggatcacttgagctcaggagttacagaccagcccgggaaacatggggagtctccatctctataaaaatgcaaaatatcag

SEQ ID NO: 53166 - DNA, 1707 bp, Homo sapiens
cagcgcagtagctgctggaggctggcgaggcccggaggcggtgcaggaagcctccgaccacgcgggctcctgatcgcgggcgcccacagcgcggacatggcgggctggtggccggcgttgtcgcgcacggcccggcgccacccgtggcccaccaacgtgctgctctacgttgctcgagcaacgtagctctacgctctacgagcgtgccgtagctcgctcgtctccgccggggacgtgctgcagcaacggctgcagggccgctaggccgactggcgccagacgcggcgcgtggccacgttggtggtgaccttccacgccaacttcaactacgtgtggctgggcctgctggagcgcgcgctcccgggccgagcgccgcgcgccatgctggccaagttgctgtgcgaccaggtggtcggtgcgcccatcgcggtctcggccttctacgccggtatgagcattctccagggaaaggatgacatatttttggacctgaaacagaaattctggaacacctatatgcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtcccgctcatcaagtactttgcagaggcactggggcccctgcagagcttccaggcccggcctgatgacctgctcatcagcacctaccccaagtccggcactacctgggtaagccagattctggacatgatctaccagggtggtgacctggagaagtgtcaccgagctcccatcttcatgcgggtgcccttccttgagttcaaagccccagggattccctcaggtgtgtgagtgtgtcctgggtgcaaggggagtggaggaagacaggggctggggcttcagctcaccagaccttccctgacccactgctcggatggagactctgaaagacacaccggccccacgactcctgaagacacacctgcccctggctctgctcccccagactctgttggatcagaaggtcaaggtgaggcagggcacagtgtttcacatccataatcccagcactttgggaggctgaggcaggcagatcacctgaggttgggagtttgagagcaccctgagcaacatagaagaaccttgtctctactaaaaatacaaaattagccgggtgtggtggcgggtgcctgtaatcccagctactccgaagcctgagacaggagaatcacttgaacccgggagaaggaggttgtggtgagccagagatcccaccattgcattccagcctgagcaacaagagcaaaactcacaaaaataaataaataaataaatatataaataaaaataaaactgtggcacctgtggtggctcactgctgtaatgccagcactttgggaggccaaattgggtggatcacttgagctcaggagttacagaccagcccgggaaacatggggagtctccatctctataaaaatgcaaaatatcag

SEQ ID NO: 53167 - DNA, 4371 bp, Homo sapiens
ctgcaacctccgcctcccgggttcaagaagtttccctaccttaggctcctgagtagctgggactacaggattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53168 - DNA, 279 bp, Homo sapiens
gcggccgactactactactactactgctcgaattcaagcttctaacgatgtacggggacatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53169 - DNA, 757 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttagggtaaatgtatgtaggtattgggggaaggggagggatcaatcgaaaaatggaagtggtttaaagttcatatttcactttttgctatctctatagcgtacaacttgtgagttacttacaggctgtaaaagcttctcaagtctaaaaatatctgaaaactaaacttgaattaactcttaatacaaacagtactttgaaaatgcagcatttaaccttgttttaaaatttttttctcaaagcatttttttccagccactcacattttaaaaggttgtattacttttagttagaactgaaagggctcaactagcatttgctgtgaccagtatgcggagtctgtgttggctttccagaattgactttttgggttgtattggcaaatcacagtcctaaatgatgaatgttgaatgatgcactatgtttttgtttaaatgagatttcctgaaaa

SEQ ID NO: 53170 - DNA, 6380 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53171 - DNA, 6214 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttaggatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53172 - DNA, 6090 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53173 - DNA, 6109 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53174 - DNA, 4966 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctgatttggggatattccctgcccaaaaaattcctggaaaattgactagtattaagtgtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53175 - DNA, 4763 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtgcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53176 - DNA, 4401 bp, Homo sapiens
ctcagtgcaacctcaaactcctgggctcaaggcttcctccagcgtcagccccctgagtagctgggattacaaatgtgactcactatgcctggctattggattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53177 - DNA, 6327 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggatggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53178 - DNA, 3079 bp, Homo sapiens
gaccggtcccggaattcccgggatatccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53179 - DNA, 2725 bp, Homo sapiens
ccgcgctgcaggaatacggcacgagtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggatggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53180 - DNA, 2593 bp, Homo sapiens
cacaggtagatagtaatatttctgatatttttatacagaggcaaaacgagatgaattcttttctcagaatttaaaattgctatttaaaaagctttgtgtaaaactttctatggtgcatctttcctctggtattgaataaaaacaaggaatagaggaatggtaacaaatttaagtggtattgtatctacatggtgaccacctgtagtgaccaccatgtgaccacaaattgcctttgaatcgttttcagtctctttttaaatgaattatttgtggtatttctagtactgaaggagttttgatattttattctgaattattccccatttaaaagagtctattctcactgcttatcagatattttctgccctttgtagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53181 - DNA, 6327 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaatgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53182 - DNA, 2128 bp, Homo sapiens
cttgatcccaaatcagtaaaagaattatttctttatgtatgttcttaaaaacaaatttttgctcactttgtgtccatgagactaggtgattcagccaactatttttaaaacggcagttttctaataatcttttttttcttacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53183 - DNA, 2074 bp, Homo sapiens
cttgatcccaaatcagtaaaagaattatttctttatgtatgttcttaaaaacaaatttttgctcactttgtgtccatgagactaggtgattcagccaactatttttaaaacggcagttttctaataatcttttttttcttacagtcttgtgctgcctccaacccagtcctcttcagattcctcacccccggaggtgtctggcccttcctcatcccaaatgagcatggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53184 - DNA, 6567 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtcaaaaaaaaaaaaaaaacaaacaaagcaaacaagaaaaaaaaaacaaaaggaaaagaagaaaaagaagacaacagcaagaaagaagaaaaagaacggaaggcaagaagaggagagaagcacagaaaagaaacaaaaaggcaaagggcaagaaaagcgcaaccgcgggagagggaccggaaggagagag

SEQ ID NO: 53185 - DNA, 6326 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaacgcattatttgaaccatttgcccttacagaaagagaaatacttgtttgtgttttaaataaaactgatgtaggaaagtc

SEQ ID NO: 53186 - DNA, 5931 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggttcgataggtgagggcatacctgctgggacaacaatctgaacgggcacgtgggtcagacggaaggagcaaggctaccactggacacgcggacgtgcgcaggtccaaagggactggccccgtcgaggccaagaccgcgagacggcccgaataatcgaccgcggaatcccgccgagcccatggcgg

SEQ ID NO: 53187 - DNA, 810 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcgcttaaatgttgatatatagatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53188 - DNA, 502 bp, Homo sapiens
tcagtaagcggagcatcagtaagggagctcagtaagcggagcagtaaggctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53189 - DNA, 4695 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggcatgcaacagcacacgcagcacagcaacccttccaggcacagtgcaacatgaaagttcgcatctctccacgagccagtcataccacgcacaccagacagcatcaaccagcagtgcctctccacggtgcagaaccaccagcgcagtgtcgaccatccactacacaatatcaacgtcaacgcagcactgtgagcaccactgagcagaccgcaagcaccatgcacgacaacagcaacggaacacggcaacaccatcaactcttgaacacacctcttccgcgggcagatgtcgccatctcttcgcaataccccacagctggcacgcagataaaacagatgctaccaacatgcatgtagccagagaaatcacacaggcaccatgaccaaagacggcatacacaacacaacagtcatcccaacgaacggctgggagcgtacgacaccctccaggcgcatacgcgaggcaaactcaatccactcacgaaccctgctcgcccaccaatccgtcggccacgccaccaaacaccacaaccgcgcacacaaaacacgcaggcgagttaaacagactgacaacccgcacaacgtcagacaccacacacaaacgcaatcaaagtccgacccacaaccaacgcaggacacaaccacaccaacacaacgcgaccacaaaaacacaacctcaaaaggccaaagtcaggaagcacatagtcagcccatgccccagcacgactctgccccgcttgccggcgaagaccacagttccacgctaccacaccaacatcgaacccacacccggcacaaaccagccacaacaacaccaacagacaacacctaaggacaagacacgccccagaccgtaaccaccgcgccaaccaaaaagaaacccaaccgaccgccctcaaaacaccgagcaaaaaatcacaaaaccccg

SEQ ID NO: 53190 - DNA, 915 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttagggtaaatgtatgtaggtattgggggaaggggagggatcaatcgaaaaatggaagtggtttaaagttcatatttcactttttgctatctctatagcgtacaacttgtgagttacttacaggctgtaaaagcttctcaagtctaaaaatatctgaaaactaaacttgaattaactcttaatacaaacagtactttgaaaatgcagcatttaaccttgttttaaaatttttttctcaaagcatttttttccagccactcacattttaaaaggttgtattacttttagttagaactgaaagggctcaactagcatttgctgtgaccagtatgcggagtctgtgttggctttccagaattgactttttgggttgtattggcaaatcacagtcctaaatgatgaatgttgaatgatgcactatgtttttgtttaaatgagatttcctgaaaa

SEQ ID NO: 53191 - DNA, 447 bp, Homo sapiens
atttgcccttacagaaagagaaatacttgtttgtgttttaaataaaactgatgtaggaaagtcttgatgttgtgagctaagtaatcttacatcatcatatcagcctgggatccatcttgacaagagaccccagacagaatgctattggcctttcgtgtaagtgcccgaatttcagttattatttggcttagaaacctttcatctggatatattgccaaatttacaagtgtgctcaattttagctgcatatgctttaggtaagaatttatattattataatgtgaggattttttttctgacacggatacttactccttagtgttgtaactcaagcaatgccattaagtttttaaaaggagggagggtttaaaagtgatcttagggagtctctctgggcctactctggctcaagaggctgataaaaaataaataaatgaataaacttga

SEQ ID NO: 53192 - DNA, 426 bp, Homo sapiens
aggctcccgttcctcataaaatttctatttgaattttcaggtgaatgtttgaattttggaataaaaactcttgaggaaattaagtcaaagaaaatgaaggaaaaatctaagaagcaaggtggtaagtcatcacgttttggcatggatagttgtatgttgctagggaagaatactaaggacgcttctagaagcaacagccaaaatgagcaaatagattttcatttccatggcctgtttgaagtaaaacacagacttatttaaattgtggttgcttttaattcactgcagctgtgtttcagtccctaacttttcagagctgggtacaataaagaatctgaaagaacttgtatatcttgaaaaatatagctctgaagaacatcatataagaactatattaattctgtaagttcttatagtggttaaaaa

SEQ ID NO: 53193 - DNA, 5905 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctgatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53194 - DNA, 6056 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttaggatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53195 - DNA, 5087 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53196 - DNA, 4782 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcgatttggggatattccctgcccaaaaaattcctggaaaattgactagtattaagtgcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53197 - DNA, 4458 bp, Homo sapiens
acagatcttctcccatcagtgtgtttacaaggctctgtataagcaaggtcgtattaataaaatttgactctagcaatacgatctcattagccatggtgatttgaaggaggaagaatttacctgaaatattttaattcattgtctcctcattttaggattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53198 - DNA, 4355 bp, Homo sapiens
tagaggcatgaattatccaaggccacctggccaataagtaacataatagagattcagaccgttatctttgatttcataaacttaaactactgtatcatcctgcttctctaaattaagtgtagacattttaggggttccaggatgagggtaaaaagggaaagaataacataaactactctcctgctccattcagctctccatcatgcctaagttatgttattttcagcaatctctcttccttctaaaaatcatctcatctcacatgcctcggatttttgaaccctgtatgaactttgtctagaaaacaaactgccacatgaatatacgtatcactgttttatttgaaagcaatgtgtttttccctcttacagaaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53199 - DNA, 6326 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53200 - DNA, 6174 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53201 - DNA, 5111 bp, Homo sapiens
gttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttccttttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgatttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactctttttttttgtttttttttggttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggtgagggttcttcaggagtttccagtcttttactccaccctgagcccgttccaggtcctgaaaaagaaaatgtcaggactgtggtgaggacagtaactctctccaccaaacaaggagaagaacccttggttagattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtc

SEQ ID NO: 53202 - DNA, 997 bp, Homo sapiens
tgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcgcttaaatgttgatatatagatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaagaaaatgaaggaaaaatctaagaagcaaggctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtcaaaaaaaaaaaaaaaacaaacaaagcaaacaagaaaaaaaaaacaaaaggaaaagaagaaaaagaagacaacagcaagaaagaagaaaaagaacggaaggcaagaagaggagagaagcacagaaaagaaacaaaaaggcaaagggcaagaaaagcgcaaccgcgggagagggaccggaaggagagag

SEQ ID NO: 53203 - DNA, 4574 bp, Homo sapiens
ccggggccctacacgccagacctggctcggggtgggagtgcagaggcaaccaaaaaggaacccacacctccctccagggcccggggcgctgtcagacggggcagcaaccaggagattccctgggcctgcaggaagcccttccgcggaccgaaagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgtcagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcgaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatacactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtatgtgtgtgtacactgttcaatatggttcaatatggtaccaatagccacatgtgactatttaaattcattgcaatgaaataaaattaaaggtatactagctcaaatatgtct

SEQ ID NO: 53204 - DNA, 4378 bp, Homo sapiens
ccggggccctacacgccagacctggctcggggtgggagtgcagaggcaaccaaaaaggaacccacacctccctccagggcccggggcgctgtcagacggggcagcaaccaggagattccctgggcctgcaggaagcccttccgcggaccgaaagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgtcagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcattccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcgaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatacactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtatgtgtgtgtacactgttcaatatggttcaatatggtaccaatagccacatgtgactatttaaattcattgcaatgaaataaaattaaaggtatactagctcaaatatgtct

SEQ ID NO: 53205 - DNA, 2289 bp, Homo sapiens
ccggggccctacacgccagacctggctcggggtgggagtgcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcgaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatacactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtatgtgtgtgtacactgttcaatatggttcaatatggtaccaatagccacatgtgactatttaaattcattgcaatgaaataaaattaaaggtatactagctcaaatatgtct

SEQ ID NO: 53206 - DNA, 4504 bp, Homo sapiens
tggagcgaaacctcaactatgccaggcgtcggcccgtaggaaggcagggaacacagagggcgctgccctcggcggcagcggcagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgtcagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcgaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatacactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtatgtgtgtgtacactgttcaatatggttcaatatggtaccaatagccacatgtgactatttaaattcattgcaatgaaataaaattaaaggtatactagctcaaatatgtct

SEQ ID NO: 53207 - DNA, 4652 bp, Homo sapiens
ccggggccctacacgccagacctggctcggggtgggagtgcagaggcaaccaaaaaggaacccacacctccctccagggcccggggcgctgtcagacggggcagcaaccaggagattccctgggcctgcaggaagcccttccgcggaccgaaagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggctgtcagtggcatgcccaaacccaaagctggaagaggaataaattacaagtggtcaaggttgctgctgtgtgtggaggtgctgtcagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcgaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatacactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtatgtgtgtgtacactgttcaatatggttcaatatggtaccaatagccacatgtgactatttaaattcattgcaatgaaataaaattaaaggtatactagctcaaatatgtct

SEQ ID NO: 53208 - DNA, 1966 bp, Homo sapiens
ccggggccctacacgccagacctggctcggggtgggagtgcagaggcaaccaaaaaggaacccacacctccctccagggcccggggcgctgtcagacggggcagcaaccaggagattccctgggcctgcaggaagcccttccgcggaccgaaagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgtcagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacaccacctttccaagaaaaatataaagggtccaagctgtatagtatttgtcagtatttttttctgtaaaattcgaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatacactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtatgtgtgtgtacactgttcaatatggttcaatatggtaccaatagccacatgtgactatttaaattcattgcaatgaaataaaattaaaggtatactagctcaaatatgtct

SEQ ID NO: 53209 - DNA, 339 bp, Homo sapiens
aatcagttacctcgtggacagatcacgtctaataatgttaatgaccacacagtattagtagcttagatgagttcagctgtgtaaaatatttagaacagtgctaagcaggtagaacatattcagtaatactatcattgttattcaatgataacattgaatatacagaaggttgcatacgccttctgctgtggttatggggtgctttcaataaacattctatatcagaagtaatatctttgctgttaaagagtgtgaatttagaaatgaagtttaaatgacatcttgagagttctgtttctagcagtggtggactaggttgtttcagaccaatcccctgct

SEQ ID NO: 53210 - DNA, 202 bp, Homo sapiens
ccactggtactataacatcaattatctgaaaccggctccctgttctccccatttatcatattttcctctcattatcttcatctgttcaagttcatccttcacatcactaattccaattttgcagataaactcggctctttactacatagaatgtaggttttaattctgttcttacgttttctgcttccctgaaatccttcct

SEQ ID NO: 53211 - DNA, 365 bp, Homo sapiens
agtagagacgaggtttcaccatgttgaccaggctggtctcgaactcttgacctcaaatgatccacccacctcggcctcccaaagtgctgggataacaagtgtgagccaccacgcctagcctgcctttcaatttaaaaacccattaaaatgtgtaatatgtgaatactttgttttttagggttattttttattgttttaaataaggtaactaggctggatgtggtggctcaaaccagtaacctcggcagtttcggaggctgaggcaggcggtttgcttgactccagaagattgagacaagtctgggcaatatggtgaaactccatttctacaaaagaaaagttttaaattagcctggagtgttggc

SEQ ID NO: 53212 - DNA, 385 bp, Homo sapiens
agacctcctgctgctggctttgggggcatctgctgtttttctcacccacaaagggcagtctgtctttgagcacttacagtgtatgcaaggagagtagcccagttctgacctgtcaatcactaggttagactctctctgaaactctcctttaggcaatggcatctaatctatgcaacagtcagagtgccagacacccagggcttgggctaggcttgcagggctcgctggagtggcccttggatcttagaactaacagaatcaagggaagtgggaaagccaaggccagactcagcagcagtagtcctgtgaaagagctagactatggggagagaaaccaaataggagctaacaggtcagctgtggacagcaagagaaagagagaggt

SEQ ID NO: 53213 - DNA, 271 bp, Homo sapiens
ccagaaaaaatggccactactaccacttggctcagaaatgctagtctttattttctgaaatgttttatatagaaaaaatttaataataaatagacattcttatatatttccttaccattttagattgggttaaaaagtatggagacttccggccgggtgcggtgattcaagcctgcaatcccagcactttgggaggctgaggcagacagatcatgaggtcgggatctgtggctaacacagtgaaacctcatctctaccaaaaatacaaaaa

SEQ ID NO: 53214 - DNA, 832 bp, Homo sapiens
gaggggatggaatctcagttcttctatgttttggcccagaaatggagcacgcatctctttatagctcaatattagaactagtggcatggcaaagagaaggtgttatctcagggtccatggaagtggagagctggatattggtgaagactggtcatggctgccactaatacatcagtgaataaagcagagattacaatctagtaaactttcctatattctattagataatgtttttaaatctctctatatatatagatttaaaattttaaaatatatatatatatatgtgtagatagatagattaaaatatagtaagaattgcctgcaggtaaggtactgaagacttatccacccccagtgcattttaactcttgatgctttagataacttaacatactatgattttctatttttatgtgttaataacaaataacacacatacttggaaatactctaaaattgatggagaactctcttctaaaaagctgtattatgctaaatgctagttcctgtgataaagatcaaatttgttaaattgatatttaccactaaaaatgttccctctttgctataaacttgttaatttaaatactaggagactccattcgttataaaacagttattcaaagcctacaatgcgtaggaaccaaatactgagactatgttagtgagtaaaactagccgtgatggagcttatatccaatagaagagatcgacactaatcaagtaatcatactggtgagaatggcttgaaccctggaggcagaggttgcaatgagccgagatcccactacggcactccagcctggacgacagaatgagactccatctc

SEQ ID NO: 53215 - DNA, 425 bp, Homo sapiens
gtaaaatgtagcacagctcataagcaattgttgaagtatggctgcctaagtgtgacaggcaggaaaaaatgctttaaggacacgttgaagcatgtccattgaggcggttagctggggaaaccacagagacaaaccaggctggaaagtaacaatcataactatatttgagacaagtcatcatcagtctaaaaaagaggcccatttcttggtgtaataaggaaattatctttttgaaaccaacaaccaacatcacgattaatatgggaaacactcagtatttctaatactgttaaggaacaaaacaggggagaccactgttcataggctatttaaggaatttacactttggattaaaaccccggttcttttaccctgacctccagggtccatggcacccctccccttcctgctccatctgcctctct

SEQ ID NO: 53216 - DNA, 887 bp, Homo sapiens
gaactgttggtttgtgttcaaggagaccccgtggcatggacagggccagggccaggaccaggaccaggaccaggaccagggccagggtcccagccaggagagtgcagctgagcagggagcagtggagaagcagtaagcagccccccacctggctattcccgaactggacagcacctcttcaaccacctccggcttccaggacctttctcttcctcctcctccaattcccctcccccatcattctggtctttgagctttgagacgatgggcaggcatcagctgttggaaacctgggcagccctctcagtggcttcctatcctccttcttgctggagccatgaatggcaggagctcagtgcttcttgtgcagtgcctggacccaggtatcttacttggggtcttacttgtacccttacagtctctgagaaccagcctctgctgcaggtgagggttgggggcaggaaaccagtgctctgagactggttcctagcagccacctttctgtcaacctgtccggcttcaacaatattagggggaagggaaatcagctagtagccttcccctctggtcccttgtgtggaggccccaatagtggtttggcgacccctcctcagtggctgtcatctagtccctgcgtctgatctccagtcatcccatgactcagtgtgccttccactgtcttctctggcctctgcctgcccacagaatccaccatgtgtgaaccagagaggtccaccagcctagaaaacagcccttcagagggtcctgatgaggccttcctggactcagctgggagcaagataaattgcaactgagttgcagcttcaagaaagtaaagccagtaagcttgctggcagaatcaatttcttctatcccctcaatcctcc

SEQ ID NO: 53217 - DNA, 425 bp, Homo sapiens
ctgcttgcaatggagtgagcacatagcacagcctccactgctctgctggtgttctgctgaagaccactgctgtcgtgcttttactgatggcccccaccactctactggagcacttttgccaacagcctcctgacacagtacgctagcagtccttaccaccccagggagtgcaccaccagcagcctctgctgtccccaaaggagtgctttagctggtggccccccaatggagtgcttttgctagcagccagagagcaccccagcacccctagcacagctggtacttgactttgaggggccagagaattaaaccacaggactggtgccagcccccagggttagagagtacagcctaggagtgtcaaggtgagccagaaacaaagttagaaagtcagtaaactatacccaatttacaccagtcaaacc

SEQ ID NO: 53218 - DNA, 238 bp, Homo sapiens
aagagatcctcttgccttgaccttccaaagtgctgggattaacaggcatgagccactgcacctggtccctttcatttttaattacctgcatttctgagtagctctagaaccaagaactagagatgatgggatggatgtcctggtcgttggtcagattccgcccactgtttggtgatgggaaccagcttatattcgtgggtcattagcatttcagatgaagtgctggcaagggaccctg

SEQ ID NO: 53219 - DNA, 199 bp, Homo sapiens
gtggtatctcattgtggttttgatttgcatttttgaaatgataagtgatgttgagcatcttttcttatgcttactgttcatttgcatattttctttggagaaatacctatttaagtcctttgcccactgttgagtcagattttttgttgttgagttttagggatactttttaaagatgctaatcacgtgaactcctttt

SEQ ID NO: 53220 - DNA, 2363 bp, Homo sapiens
taataatagccattcggactggtgtgagatggtgtctcattgtggtttgggtttgcatttctctaatgatcagtggtgttgagctttttatcatatccttgactaagacccatcagtcaatttgtggaatcaagactggcttcaagatagactaactcctagtagactttttcactaacagttacaatccctgaaccgcagactctacactgaaaaggtcccatcatatgggcactcctgctgctgagaaaattgaacataacagtatttcagataaacctatgagaagatgaaactaagtggaggtagaattcaaacttgttcagagaaagatacaaaacgagagacgtgaaataaccattgtctgtaggtctgacagcaagaaatagagatagaagagcttcatttgaagttttgaactgtttaccttaaaaatattaatggtgaatgcttatcaatcatgtctgtgtgtcaggcactgttctaagtgctttatgttcattaaccatttgcagtaaatactgttttccttcccacaaaacaagtgaggaaagagaggcttagagaggggaagtcagtggccccaaatcctgcagttgataagtgatggacttaaccaggatttaaccctcggcagtctgatccccgagctccgagtgctaatcgttcaccctctccctcctcccacccttccaaccctcaaagagacccccagtgtgtgtggctccccctacgcgtcaggaacatcgggccattcaagcagcctttaggttatagagatgatttacagtcacatggaaggagagttttgcttaaaactggtagaagaaataggtaaagtaagtgggaaatgaggtaagcttgctagctacacaaatcatcttcacaactcgaagctcaaataccctcagtgttcagctggtgtgtcttcactatttgatgtgcagtaaatattctcgcttctttttcactataagagcaacgtcattttcagtgtccacaagctggattcacgtagatcccccaaatccttaaacatctgtgaccgttggtgtataaacggtcgaagcatttgatcaacttcctaaaaaaaaagtgaaaaaaattatagtgatagatttcatgtcatcagtaaaaaatgtgtgtgtatgagtggggtgcccactaagttcccctttgggatagaaaactgcttttgaaagctgctagcagaggcagtaagtcacctaggagcagttttgtttcggatgaccctaagttactgccagtagggaaaactggtgagataagtcaaatattttccactggaatgttacttccttagtgttttaatactgtcgaaggagtattaaaggagtcttgaggggccagtgggtgtaggggctctcccattggtagggttttgccgatgcttcccctaacctgtggaggcaagtacccctgagaactagggatgccctggggcagagtcctggagacaagtgttggaggagatggtaccgcactggctgaaaatgggaacggcagagagcaggtagtgtgacgtgatggaggagatggtaccgcactcactgaaaatgggaacagcagagagcaggtagtgtgacgtgatggaggagatggtaccgcactcactgaaaatgggaacagcagagagtggcactgggattcagtttctatttccctgagtattagtgaaatgcctgttcaaatcctttgccgatttttttcgaatgtgctttccaacatattatctttttttaaatcttaaaagtaatagtttattctgaatactaatgcttgctaaataatattaatatattttccaggctgtggtttatttgaaactttgtttaaggtgtctttcatttaaccagttattcttttttattgtgagctacgtagaacagaaaagtaccctaaatatattgacaggcctaaagtgaacacacctgctctagagagcccactgcctggaactcctcctgtcaccttcttcctgtcccagaagcaactgccagcctgacttgtgtggtcaccattttcttgcctttctcaatagttttgccacctagagtatatccctaaacagtatattttgccctctttgaatgtttatagaatcatgttggatgtcatctttcgtaacttggtttccatcactattggaagactcttcttgttgcctgtggctgttgttcactttcatggcaatgtagtgttacacagcatagaggggccaaaatttacccgtcttcggtgaacatgtattagggatggaaaccaagttacaaaagatgacatccaacatgattctataaacattcaaagagggcaaaatatactgtctgagtcactatctt

SEQ ID NO: 53221 - DNA, 515 bp, Homo sapiens
tgttaaatctgacttttatttgcaactctagaatcgggcaacacttcattctataaaatggaatgagtgttcaaatgagctgagcagaggagattggttttacagccagaaaagggctgaggaaagcagaaacagaaaacaaaaagattggttgtttcaaagttactttccttgtaactttgaaggctaaagcagaggggacttccttatcctgccagctaaaacaggatggtttggagatctagctatctctcactcttctgatttatcggaatatcagataaacaacttagtttccacttggtgatgtagaactttagcatgagtgactccattttggttctgttgggcttggtgcaggagccctgttcaaaccaatggcctccaatttttttttttttttgagacggagtcttgctctgttgcccaggctggaatgaagtgttactttctgagctcactgcagcctccacttcctggattcaagcaattctcctgcctcagcctccgaagta

SEQ ID NO: 53222 - DNA, 817 bp, Homo sapiens
ccagccttaagttcatgtattgaaccaatgatttctaagtggtttagcttattattaaagtgtcctttaaacatggcctaaaccttggctggtgcagctggaggagtgagagctgatatcagaatgctctggcctgtacatcaggaaaatgctaacacctgccccaaccagatgctccttctccaaccatccctataccacaaatcaacttttttttttttaaaaaaaaaacctacagtggtggggtttcctttttaaaatacctgcctcctgatgagactgtgagagaaggatgattttgacaagggtgtagtctcaccaggattacaaaattggctgaaagctgaatgggttcctcaaatatattttttgaacatttggatttaaatgcttttgggcaggaggagaactctccagtgattctcaggtccagccactctctagtgtgttttgactggccccagtaagtatttaggttggtagcccttgtggcaagttctgtttacaggcatctagaagagtacaagaaaacttgcatgctggctgggcccttggcacctgaataaaggatccaaaaaccagacagcctgagcagccatagattcgtatctgagtggggccagtaaagacatgggaactcacttcatagaccccgagtttcagcctgccagtcccaggcccagctgctctcacaagttatttaggttcctctttctggccacacaagctacagctggaaaaatccacctgaacagcctaattttctaactcaaaaattcaggcttaaccagcagcatttgtgggcaaggatcataaa

SEQ ID NO: 53223 - DNA, 140 bp, Homo sapiens
tccagaggtcttttatttttttaacacccacgatgccatgaattcatagggaagaggttccagcagctcaggctccttcccattggttctcacagtgtgctgctctgggtggagcaggctggcgcttcagttgaatccag

SEQ ID NO: 53224 - DNA, 316 bp, Homo sapiens
gaatattgttaatcaatatccacaccttcaaaatgctcatacttagctgagaggcacaaacttcagccagctgcaactccagcctctgcagctaataatgccaggccaggatgtagctcctcattattgagtaaattaggattaaatgataaattactgactccaacgttattgctcaggattctcaattacaaacaatggaatctactggactatattaaacaaaaaatgaatttagtaaatgacatcagatagcaaacagcatctcaaaggggaccaaagagccacattctaaagctacagattaggaacaatg

SEQ ID NO: 53225 - DNA, 735 bp, Homo sapiens
aagtttcactatgctgcccaggctggtctcaaactcctgggctcaaccgattgtcccacctcagcctcccaaagtgctgggattacagccgtgagccaccatgcctggccattttctgttgtttataagcctcgagtttatggtgttttgtgatagcaggctgcatagattaacacagggaccttggacaaagcagagtggtctttccaactatggatacgattgtgtccctccccagctcacacaccctccttggctccccaatgccctcagtgtggagctcatactcctcaggtcagcattcagggcagtcagcccctgcgtttacttcgtggctcaccttagcattgcctcagctcactgagctagactctgcacaaacacgaggcaccgagacatggacgccatctcagagcagaccagggcccctggggcgcctctcagtgggatagggctgcagctttctccttgatccaagtgcttttgagttaaatctgctgccaacgactccaccattcacaggccagggcatctactgtgcgctagccacaggtgctgggcctgggcaagcctggcccccactccctgtagtggggcaggtgcaggcgggggtggctgctcggaggaggtggcctgagggatgtatatgagtttcccaggcagccttaggagggagggtggggatggagaaggttacccttctccatggagggtggtgaggggctgagttttatc

SEQ ID NO: 53226 - DNA, 413 bp, Homo sapiens
caggaggatctcttgagcccataagttcaagactgcagtgagccatgatcacaccattgcactccagcctgggcaagggagggagaccctgtctctaaataaataaataaaataaaatggccataaaacagcatgctgaagcccccttgatcatacagtgccagtgtctctcaccctcgaaatcagttcttcaggtctaatccaaatcctgtttgccccaattcagtaaatttcctctggttttttatccaatggtaaaaaaaagaaacatattgtaacgccattctccaaacaccatgctaccatggcagatttagagaatagctaggaatagtgtgccctaacacaggacttggtctctggcaaaattaccaaagctgagaccaaacagtatggtctagctggtgtcctta

SEQ ID NO: 53227 - DNA, 771 bp, Homo sapiens
tgtaagaagtgcctttcacctcctgccatgattctgaggcctccccagccatgtggaactggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatgatgcttctagtttatggacaaagacccctgaagaaattgaagaaaaaagagcaataaaggagatgtgttataaatctggggaatactacagatttcatactcctccagatattttgtcatcaaaaagcatgacacctacagcagaaaaacagttagaaaagcctttggaaaatggcagtgaattgcaagaaggagatagtcttacagttccgacaaaacttagccaatatgaaaggcaaggtgaaataaaaacatcattgcatgggaaaccaaagactgacattgctgcttttgaaaatggaggtgagttaatt

SEQ ID NO: 53228 - DNA, 772 bp, Homo sapiens
gaagtttgagtttgtgtgcttactagcaaccactttcagcgtttctgcaaagctagagaagggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatgatgcttctagtttatggacaaagacccctgaagaaattgaagaaaaaagagcaataaaggagatgtgttataaatctggggaatactacagatttcatactcctccagatattttgtcatcaaaaagcatgacacctacagcagaaaaacagttagaaaagcctttggaaaatggcagtgaattgcaagaaggagatagtcttacagttccgacaaaacttagccaatatgaaaggcaaggtgaaataaaaacatcattgcatgggaaaccaaagactgacattgctgcttttgaaaatggaggtgagttaatt

SEQ ID NO: 53229 - DNA, 392 bp, Homo sapiens
tcagcgagttctcctgagatgtcacttcatctgtctcccctccctcacacctactggtactctccacataggcctattttagctaaaagtggcttagggagaaaaaaaataatttacttataaatttttaaatttcagaagtaacttatagcttcaggcatgtttggatttaggagttttaaacaatattgtcctgactctgttgtctccatcaaagggttctgcttccccggctttctctcacaggtcctgcacgtacaaaggcaaaaaaggccattagcagctctggccttaaatctaccagctgagaaacctcagtggaaacaatatcactttcccactaactttcatagaagtccggtgctgacactctttgggctgactagggtccc

SEQ ID NO: 53230 - DNA, 338 bp, Homo sapiens
  misc_feature (191)..(191): n is a, c, g, or t
  misc_feature (196)..(196): n is a, c, g, or t
  misc_feature (249)..(249): n is a, c, g, or t
  misc_feature (264)..(264): n is a, c, g, or t
  misc_feature (280)..(280): n is a, c, g, or t
  misc_feature (321)..(321): n is a, c, g, or t
ctagaaaggcctgtctgtctagattcttcttggcatctctgagcatggatttcattctggatatggggcaggatgctctctggaatgagggtctttagacctgtttctttgttcttgatgggaccccagagaggacatcacgctttgtaactggttcttcaaggggagaagcaaatgtgtccctgaaaacnttcantgccgcgtttggcaccaggtttgattgacaaggactggtggagggaaagcgcnggaggctgggcatgngtcgtgcatgccgagncagagacaaagaggttttgccatgtccccagagagtggaangggccctgggggtaact

SEQ ID NO: 53231 - DNA, 334 bp, Homo sapiens
taaaaaaattagccgggtgtgatggcacgcgcctgtagtcccagctactcgggaggctgaggcaggaggatcgcttcaacctgggagacggaggttgcagtgagccgagatcgcgtcactgtactccggccttgcgacagagacaacgtctcaaaaaaaaaaaagattaagttttaaaaaagtaaaagacttctttcttcgtttgtaatccgtccctccttcccacgccattccctggcattactgcttaggtatcctttgtgcctgccctgctttcttcaagctgaatcttgggtctctaacttcttccttggaaaggatgggtggtgatcct

SEQ ID NO: 53232 - DNA, 5690 bp, Homo sapiens
ggcggttaagtcctgtacctaggaaagagggcgagctctggggcgctctccggtgtcatgaggagcttcaaaagagtcaactttgggactctgctaagcagccagaaggaggctgaagagttgctgcccgacttgaaggtgggggtgctgcctggctcgggatacacctggctttccaaactgagctgttttgtgtttgccttttgaagagatggataagagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggtcggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatacaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacaggtgaacttcagtgatgacagtgacttggaagaccctgtctcagctgaggcctggctggcagaggagcctaagagacggggcactgcttcccggggccgggggcgagcaaggaagggcctgagcctaatgacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtctttctaccctggactccatctgtgactccctgagtgttgctttccggggcattagtcactgtcctcctagtgggctctatgcccacctctgccgcttcctggccttgtgtctgggccaccgggatccttatgccactgctttccttgtcaccgagtctgtctccatcacctgtcgccaccagctgctcacccacctccacagacagctcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggggtgactgtgtgtgtgttggccctggccaccctccagcccggaaccgtgggcaacaccctcctgctgacccggctggaaaaggacagtcccccagtcagtgtgcagattcccactggccagaacaagcttcatctgcgttcagtcctgaatgagtttgatgccatccagaaggcacagaaagagaacagcagctgtactgacaagcgagaatggtggacagggcggctggcactggaccacaggatggaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaaatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggacttgcagaagctgccgtgggaaagcatgcccagcctccaagcactgcctgtcacccggctgccctccttccgcttcctactcagctactccatcatcaaagagtatggggcctcgccagtgctgagtcaaggggtggatccacgaagtaccttctatgtcctgaaccctcacaataacctgtcaagcacagaggagcaatttcgagccaatttcagcagtgaagctggctggagaggagtggttggggaggtgccaagacctgaacaggtgcaggaagccctgacaaagcatgatttgtatatctatgcagggcatggggctggtgcccgcttccttgatgggcaggctgtcctgcggctgagctgtcgggcagtggccctgctgtttggctgtagcagtgcggccctggctgtgcatggaaacctggagggggctggcatcgtgctcaagtacatcatggctggttgccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcatttaaaccctgaaaaaaata

SEQ ID NO: 53233 - DNA, 354 bp, Homo sapiens
gtggggttcagggcgtagtgtctggggatgactggcgactggggaagacgtcaacaaagaagggcagagaaacctgagaagataggagagggtcctaggaatggctcagacatggaaaggggctgagattgttagagcttgggcctcttggtgagacaagcatcctaatcgccagtgtctcctcctcagtatggggcctcgccagtgctgagtcaaggggtggatccacgaagtaccttctatgtcctgaaccctcacaataacctgtcaagcacagaggagcaatttcgagccaatttcagcaggtcaggggcgcgaagacaagaagacgtgtggggaagggtagacaacata

SEQ ID NO: 53234 - DNA, 6679 bp, Homo sapiens
ggcggttaagtcctgtacctaggaaagagggcgagctctggggcgctctccggtgtcatgaggagcttcaaaagagtcaactttgggactctgctaagcagccagaaggaggctgaagagttgctgcccgacttgaaggtgggggtgctgcctggctcgggatacacctggctttccaaactgagctgttttgtgtttgccttttgaagagatggataagagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggtcggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatacaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaacttcagtgatgacagtgacttggaagaccctgtctcagctgaggcctggctggcagaggagcctaagagacggggcactgcttcccggggccgggggcgagcaaggaagggcctgagcctaatgacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtctttctaccctggactccatctgtgactccctgagtgttgctttccggggcattagtcactgtcctcctagtgggctctatgcccacctctgccgcttcctggccttgtgtctgggccaccgggatccttatgccactgctttccttgtcaccgagtctgtctccatcacctgtcgccaccagctgctcacccacctccacagacagctcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggggtgactgtgtgtgtgttggccctggccaccctccagcccggaaccgtgggcaacaccctcctgctgacccggctggaaaaggacagtcccccagtcagtgtgcagattcccactggccagaacaagcttcatctgcgttcagtcctgaatgagtttgatgccatccagaaggcacagaaagagaacagcagctgtactgacaagcgagaatggtggacagggcggctggcactggaccacaggatggaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaaatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggacttgcagaagctgccgtgggaaagcatgcccagcctccaagcactgcctgtcacccggctgccctccttccgcttcctactcagctactccatcatcaaagagtatggggcctcgccagtgctgagtcaaggggtggatccacgaagtaccttctatgtcctgaaccctcacaataacctgtcaagcacagaggagcaatttcgagccaatttcagcagtgaagctggctggagaggagtggttggggaggtgccaagacctgaacaggtgcaggaagccctgacaaagcatgatttgtatatctatgcagggcatggggctggtgcccgcttccttgatgggcaggctgtcctgcggctgagctgtcgggcagtggccctgctgtttggctgtagcagtgcggccctggctgtgcatggaaacctggagggggctggcatcgtgctcaagtacatcatggctggttgccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcatttaaaccctgaaaaaaata

SEQ ID NO: 53235 - DNA, 4725 bp, Homo sapiens
ggcggttaagtcctgtacctaggaaagagggcgagctctggggcgctctccggtgtcatgaggagcttcaaaagagtcaactttgggactctgctaagcagccagaaggaggctgaagagttgctgcccgacttgaaggtgggggtgctgcctggctcgggatacacctggctttccaaactgagctgttttgtgtttgccttttgaagagatggataagagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggtcggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatacaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaacttcagtgatgacagtgacttggaagaccctgtctcagctgaggcctggctggcagaggagcctaagagacggggcactgcttcccggggccgggggcgagcaaggaagggcctgagcctaatgacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggaggttgcaatgagctgagatcacaccattgcactccagcctcgatcaacagagtgagaattgtacaagatcaggaatcaaatggatctgatcctca

SEQ ID NO: 53236 - DNA, 456 bp, Homo sapiens
ctccaaactgtgaccatttgcacttagaactagaaacagattgacaatactcaaatatcacactccaggatgtctttgagtctcaggcttataataatggagacattgtcactcttgtaagcatctgaaaggagtgcttggtggagaaattactaagaatgttctcggaaatcttggggtctacttcctccaagaagtcagaaacaggatgcagtggactttcaatgagtcattaatttgacattcattggcccttttgttggcagaatttggggaaaaaaatgggtttattttcgtggcgccactaggactaattctagggatggcacaaaatgcgggacagctgcttaggagtgcggggcggcgtaatcctgcgccctctgtttaccagtgtgaaaggagaaggtggtgcgcaacggtgatgccaataggccctcgagggatttgaattgaccc

SEQ ID NO: 53237 - DNA, 282 bp, Homo sapiens
ctctactgcagttaacatttacctgccaggcactaggctaagtattagcagcaggttcaaagtgcataagatatagaccttgtcctcaagacttagtttattaggagagacatgaatgtaaacacatcatgaaaatccattataataactgcaataattgatatatcctgaagatgcagagattgtctagaggataaagttatatattctgtttggtaggggatgatgtggagttcaaatggatcagagaacacttcgctgattagaagtcagttgatccac

SEQ ID NO: 53238 - DNA, 789 bp, Homo sapiens
caaacttggatcagaagttttattccatgctctccaaatagtaattctttcccaatttcatctaaagaaaatgtttaagataaagacagaagaaaatatgtcagaattattcttaactttattatttatttatcgagatggggtctagctctgtcacccaggctggagtacagtggcacgattacagctcactgcagcgtcgaactcctgggctcaagcattcctcttgcctcagcctcttgagtagctaggagtataggtatatgccaccatgcccagctaattaaatttttttgttgttgttgttgttgaggggtcgtcttgctgtgttgcctaggctggtctcaaatttctgacctcaagtgatcctcccacttctgcctctgaaagtactgggattgcaggcatgagccactgtgcccagccttaacttttaaaaatggagaagatacagtacagcctttatggacatgctctggttacttaaaaaaaaaaaaaaaaaaaaagagacagtgtctcactatgttgtccagactggtgtcaaactcctgggatcaagcaatccttggcctcctgagtagccggaactacaggcatgtgtcaccacacctggccctggtactttctgagttcatataataacaaaataggctgggcatgatggctcatgcctattatctcagaactttgggaggttgaggtgggaggatctcttgagcccagaaggtccaggccacagtgagccctgacagcgcttcaacctgggcaacagagtgagaccctgtctca

SEQ ID NO: 53239 - DNA, 450 bp, Homo sapiens
ggggcacagaagagctgggagcaggtcagcagttgaagagtggctccgggaggggccgcagaggcccagggcctgctctcaggggtcgctggggacaggagaggctccgacaggggccgcccagtgtgctcttctctcatgtgctggggcctctctcttcattccctgctggaaacatccatgctgtgcttggcggggctgcgtttccccgtggcacagagctcccaggaagggctctcctgccctctcgtggcggcctcggggcagtggcctgtgggggccgccagcccctccttcgctgtgtgagccgctggtcacagaagactgcggtgcagggaaaggggccacttcctgatactcagggacagattttcttctcttgaggaaagcctcataagacctcttccgggtcattcctgattaggactttaatccaggggtcaacaaaag

SEQ ID NO: 53240 - DNA, 444 bp, Homo sapiens
ggacagatgaaagactgtctgggcggtgtaagcctgcatgtatttccctggaggcagtcttccagtcactgggtgttaggcatgcgtgggtgcacatgtgagtgtggcatgaagagccctttctcacacctggaagggctgaagggctggctacggagggcccctctgcacctcacatgctggcaatgctccaacagggctacttcgcttgatacaaggctagattattgagaggtgctgtgaatcccaaggcctcatgaatttttgaagttgtcacacgttagtggtgttgggataggctatctcaacaactgactataattctggacaggaaagcaagaatcaaaagcttcaagggcaatctctagctataccttactaacctcactccctggctgacatgcccagaaaatatagacagacagcaaataaggcaaagctatc

SEQ ID NO: 53241 - DNA, 1083 bp, Homo sapiens
ctttggttggacatgcatgcttcctgaccctccgatgtgagaatgtggggtgtggagacaagagtgactccatcttggatgctgatatagtttggctctgtgtccccatccaaatctcacctttaattgtaatccctataatccccacgtgttaagggcaggaccaggtggaggtaattgaatcttgggggcagtttctcccatgctgttctcgtgataatgagtgagtctcatgagatctgatggttttgtaagtgtctggcatttcccctgcttgtactcattctctctcctactgccccgtgaagaggtgccttccgccatgattgtctgtttcttgaggcctctccagccatctggaaccgtgagtcaattaaacctcttttctttttaaattatccggcctcaggtatttcttcatagcaatgtgagaatgaactaatacagatgctaatctgccctgttgacttctgattagccctggtcctgtgaaaacctcctgattctcactttatttactgtctttagcgtaagaacatgtcagccttgatgttattgcacaaattataggttatgatgcatgtagcattcttgcctgttctggagggctgcctttaattgtcttgcatagagcatgtataccctttccctgtgatatataagccctgggtctggggagcaacagtgtggagatctacctgttttgctgctctccaagactacacttccatccttaagttccccaaataaatcactctgtactgacaaattggatttgtctgcctcactttggtgataagttaaaatgacatcacactaaaacttgtgagatgcaggctgggcgcagtggctcatgcctgtaatgccagcactttgggagggtgaggtgggtggatcacttgaggtcaggaggttgagacccgcctgaccaagatggtgaaattccgtctctactaaaaatacaaaaaaatttacccgggcgtggtggtgggtgcttgtaatcccagctacttgggagcctgaggcaggagaatcacttgaacctgggaggcggaggttgcagtgagcaaagatcgtgccact

SEQ ID NO: 53242 - DNA, 482 bp, Homo sapiens
gaaataagtgagcacgggatcagtcataaggtagcaaagaaaagaaatggaacctgggtggcagagcacaaatgaattggactctatcttacccaaaggctgtgattcaaccctgggtggcagaggtggttttggttctctgtgggaccctagataggctgtgtatcttgattctcttccatgtttttaagagtagtgtaatggggctgggcatggtggctcacgtctgtaatcccaacactttgggaagccgaggcaggtagattgcttgagcccaggagtttgagaccagcctgggcaacatggcaaaaccctgtctttacttaaaatacaaacaaatgggcatggtggcacgtggctgtagtctcagctactcgggaggctgagtttgggggaatcacctgaacttgggacgttgaggctgcagtaagccgagatggtgccatggcataatagcctgggggagaacgctgtctcaaaaa

SEQ ID NO: 53243 - DNA, 595 bp, Homo sapiens
ctctagggcctggcatttaatagattctcaataaatatgtgttggttgtatgaccaacattttggtgagtttacatttttttcctccaggaacttgagagacaccacctatgattgagtgtgtctgtgagatccttagaggccttgcatcagaaggtcatcttgacagttctgtgagaggacaggggaattggactctatcttacccaaaggctgtgattcaaccctgggtggcagaggtggttttggttctctgtgggaccctagataggctgtgtatcttgattctcttccatgtttttaagagtagtgtaatggggctgggcatggtggctcacgtctgtaatcccaacactttgggaagccgaggcaggtagattgcttgagcccaggagtttgagaccagcctgggcaacatggcaaaaccctgtctttacttaaaatacaaacaaatgggcatggtggcacgtggctgtagtctcagctactcgggaggctgagtttgggggaatcacctgaacttgggacgttgaggctgcagtaagccgagatggtgccatggcataatagcctgggggagaacgctgtctcaaaaa

SEQ ID NO: 53244 - DNA, 328 bp, Homo sapiens
ttgtgtgcaaatgacatgccagttaaaatgaaaacgatctcacatgtagaaaaagaaagtctggattttaaaaaagaagaactcataaaacccttactaaatgacaccatctgattcaagtaaaaaatgacttaaacactagtaataaaaaaagacaaaacacatttcatgaagaatacaaaggtaaatgtctgctgagtgttttagtttagatgtttcagatgctgctgtatgtttgatgaggaatttgaggagaagatttcatcgcagaaggtgttaatgtggcctgtattgacttaagtggtgacccaactggactgtgaaactg

SEQ ID NO: 53245 - DNA, 329 bp, Homo sapiens
tttataatactcggaaaatacaaccataaacatagtaaatacaatttttaaatgtgttttaaagaccaaattttgccatttaaaaaagctcataatttcaaagaaatactgcctgattatttttaattcaatttcttccatttgtagtactgtaaacactttatatacctacaattgttagtgctattaatgttgctttgccaattatcttgatgtaaaattaacagataaaatccttaatgtcataaagcacttgaaccacatctgactgtgtcatataaacttagatctcaaagactgccagttatgaaaatacttttattagtcac

SEQ ID NO: 53246 - DNA, 413 bp, Homo sapiens
ccagcttgggagacagcaagaccccatctctctcttttttgagatgtagtttcactcttgttgcccaggctggagttgcggtgagccgagattgtgccattgcactgcagcctgggcaacaagatcaaaactccatctcaagaaaaaaaaaaaaaaaaaaatatatatatatatatatacacacacatatatgtatgtatgtatatatgaatatgttcttgtaaaatatttgcataatacacaagcatgcagaggaaaatgtaacagtctccctgctgcatccccaccactgaagtacccccttcccccagttggtgacttggcatcttttaggtcccttctttatgtaacggtaacttcatacatctagatgtacatatacatgcataagtttaaagcatttttaaaaatca

SEQ ID NO: 53247 - DNA, 410 bp, Homo sapiens
aaaatgcctaatccagatatttcagtgtgtagaaatttcctagaattgagttgccggacatcagaatgtgattatatttaggagtttttaggtgaagtaaatcttgtgcttgttattctttccagagtggggagtgttaaagcgaacagacgctttcttgactactgctagtgtggtccatcacctttgttttaaaaaaggtcttaagggtatttcctaatatttaaaaatgttgatggtattttagggtttgtttggctttaatttacgtctacgtttttttttccactgtcaagtagctattgttcatagagcataacatgagtggtaaaatagcctttaatgatgcagcaaggatggggtagatgaattgggctatagaaatataccaatacatggagattatttcc

SEQ ID NO: 53248 - DNA, 210 bp, Homo sapiens
aaatagttccaactttggccataggagctctttccattggattgcatgtccttttgccatgactctgaggtaggagactggactcagttccagaggcagggcttggacactgaaccaaattgaggactagctaaaacagagatggggcagaagcacctttctataagacacacccaccagtgtgccatggcaacatatggaagttaccac

SEQ ID NO: 53249 - DNA, 554 bp, Homo sapiens
caggaatatgatatgagaacatagcctttgaatttctctctcaagtttgacttgaaaaatcagcctcagaaacatctttatcttaagatagatttccgttgctctcagaacgtctctcccctgaccttctgttattaagttcatggacatacagcattttagaattaggtgggggctccgaagtctgcgagtgcagctgtgcacaggtaagtcacttcacccgcctggtgctgaatttcctttgggtcttgaagcagggccgcgttgaaacctgggtttctggacgttgtagctaccacgcagcctgtttctggaagcttggtgttaaactccctctcctggcaggttaaattcattgcaaattcttcaactctcctttgcctcccaacagaatttttagatttagtaaataaagtggcattttcattttgtggatggggcaaaatggactggaaagagtctgatgtgtagagatgtgattttcttggggcaacgtgatgccgctctatgtgtgccaggaggtgctgagcctgtttgaagctcttatcagatct

SEQ ID NO: 53250 - DNA, 578 bp, Homo sapiens
gtcagaaagaaagagaaaaaaaaaaaaacacaaaaatagccattaggaaatcatatcatagaactgattgtttgaaaagtcattgacttcttagaattaaaaaccaacaccaaatttgtattcctttcagttttgttttatgtttctcataagttttttacatttgtttatttttttcttctcattctcttttgttttccttttgttcatttgcttctataccatgtaacactgtgtgttaggctagtagcattaccagagagctccaggggagagagctaaagcttactaaccttcaggaaaatttgagtgaagtcagtcaagtgaaagagactttggaaaaagaacttcagattttggtaagtacctgttgggaatctgaatctcagggtttctggccatttcctgttttaaaaaatcctccagtaagaaatattgtagctgtttcctttctctttctaagtgttgattcaacttgagtgtattagttattggctgataaatattgtcctttgaggggaatcggatcaaacccaaacaacaaaggtaggtatactttttttttctaaaacgtggga

SEQ ID NO: 53251 - DNA, 121 bp, Homo sapiens
  misc_feature (106)..(106): n is a, c, g, or t
tgccaaagttaggtgcctgtttgatttcctttccctttgtttggcacggttttattaaatgggcttgttctattgctaaactcctctgctggaaatgctgacgggnaccgagctcgaattc

SEQ ID NO: 53252 - DNA, 5830 bp, Homo sapiens
gaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgaggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53253 - DNA, 5890 bp, Homo sapiens
gccccgattctacagacaccatgagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53254 - DNA, 6261 bp, Homo sapiens
ggggacaggtggcggcgaccggcggcgtccgaggagagacagagtctcactcggtcaccaggctggagtgcagtggcacaattataactcactatagccttggactcctggactcaagccgtcctcctgcctcagcctcccaagtagctaggaggtgtgtaccaccacacacatttacattagggtcaggagcctggagattggggttttagtcctagactgttaaatggaggaacattgggaggctctttattttctgcgtgctaagtagtaggaatataaatctgcactcagactgagctgtgcaaaggcattcataattgcaggcagttgcatcagagctcagagttccatctctaaaaaaaacattgtcttatgccccaaccttctccctggatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53255 - DNA, 6278 bp, Homo sapiens
tgttttttgtttgtttgttttgagttggggtcttgctctgtcacccaggctggagtacagtggtgtgatcgatcatggctcactgcagcctcaaactcctgggctcatgaaatccttccccctcagcctcaaacagtcctcctatcttagcctcccaaagtgctgggattacagatgtgaggagtgggtcatggcacctggctaactgcttgtcttgaggatagtaaattgcctttaaatccatttcagcagcattttcatgtgtttaataaccagagtcttctaggttcctaggttcagcctggagatggattattgtcaaatgaaaggaaagctttagtctatgaaagctacctgttgttcctacttgctcctgtagattataaaatctttttatttctttctctttgcagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53256 - DNA, 5357 bp, Homo sapiens
tgccaaagttaggtgcctgtttgatttcctttccctttgtttggcacggttttattaaatgggcttgttctattgctaaactcctctgctgtacatttatcaggttgtgaaaatatttatttcctttatgcagaatctcagcaacaggtgagcaattctgactctgtgtatcatattgtcaccagtgtgtgttctaaaccatcactgaggttgttagcctacatacatgtgactgctacgtgctggtgtgtaaccccagcttagctgtagaatttccaggaatccaaccgtaagttaggagttgggagaaccttttggttatagttattatttcttgtgattaagttgttttttgttattgttcttattgttctctaaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53257 - DNA, 3583 bp, Homo sapiens
gtcagaaagaaagagaaaaaaaaaaaaacacaaaaatagccattaggaaatcatatcatagaactgattgtttgaaaagtcattgacttcttagaattaaaaaccaacaccaaatttgtattcctttcagttttgttttatgtttctcataagttttttacatttgtttatttttttcttctcattctcttttgttttccttttgttcatttgcttctataccatgtaacactgtgtgttaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53258 - DNA, 1497 bp, Homo sapiens
  misc_feature (15)..(15): n is a, c, g, or t
taggctaggtagagncggggtgtgaatcggcgagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53259 - DNA, 1734 bp, Homo sapiens
tgctcggtacccccatttcttagcatttacctttgaacatgtgcctgtttgctaatttttggactcttagaaagtaaagatgttacttctcaaacagcatttatagaaattctaatatttctggctgggtgtggtggttcacacctgtaatcccagcactttgggaggccgaggtgggtggatcacttgaggtcaggagttcaagaccagcctggccaacatagcgaaaccctgttgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53260 - DNA, 678 bp, Homo sapiens
  misc_feature (23)..(24): n is a, c, g, or t
catgggccggtaccacttatganngacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53261 - DNA, 4438 bp, Homo sapiens
gaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcagtacagacactcaggcagacgggatgagctcaggacagagccagaggcaaagaagagtaagacggccgcaaagaaaaatgacaaaggggcagcaggagagggcccagccctgtatgaggaccccccagatcagaaaacctcacccagtggcaaacctgccaaactcaagatctgctcttggactgtggatgggctacgagccctggattacgaagaaaggataagatggggtaaaggaagaagccccagatatactgtgcctccctaaagaccctaataagtgagggtcaacttttcatgcagaacgaggcatcttgtaccccatggagacgtgagctatatatccccaatgtctaatttggcctatctaggccatccta

SEQ ID NO: 53262 - DNA, 3780 bp, Homo sapiens
gaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcaggggacccaaagttcccaaagtcattcaaaaaggcttgggaaagaaaagaaaaggaatcctgggggcct

SEQ ID NO: 53263 - DNA, 1423 bp, Homo sapiens
gaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactagtaaggcccctttctcactacctgcctccacttcccaggcaggattaaggcccgtggtcagtgcccctgctttgctgctttgctgctttgcttgtccttgtgctgaatgttgctcacagcttttgctgtgaaagtctttgcaagtaagttttgaaaaatgtaactccagcaagaatgcgttttttgaaatcagaaagtgcttttaatagtccctttcagattcttaaaagcttaaaaatgca

SEQ ID NO: 53264 - DNA, 861 bp, Homo sapiens
tgccaaagttaggtgcctgtttgatttcctttccctttgtttggcacggttttattaaatgggcttgttctattgctaaactcctctgctgtacatttatcaggttgtgaaaatatttatttcctttatgcagaatctcagcaacaggtgagcaattctgactctgtgtatcatattgtcaccagtgtgtgttctaaaccatcactgaggttgttagcctacatacatgtgactgctacgtgctggtgtgtaaccccagcttagctgtagaatttccaggaatccaaccgtaagttaggagttgggagaaccttttggttatagttattatttcttgtgattaagttgttttttgttattgttcttattgttctctaaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactagttggtggcactaaggctggtgtagtccggtttcttggggagaccgactttgctaagggggagtggttgtggcgtggagttagatgagccacttgggaagaatgatggcgctgttgctggaacaaggtttgttcggcgttgtgcaacatcttgtgtcactcttgtacgtgacgatgctcaggccagtctcaccaagcgtgtatcataacatggaaagtcgtgtttggaagagtggcacttttatttcctaagttcaga

SEQ ID NO: 53265 - DNA, 664 bp, Homo sapiens
ggggacaggtggcggcgaccggcggcgtccgaggagagacagagtctcactcggtcaccaggctggagtgcagtggcacaattataactcactatagccttggactcctggactcaagccgtcctcctgcctcagcctcccaagtagctaggaggtgtgtaccaccacacacatttacattagggtcaggagcctggagattggggttttagtcctagactgttaaatggaggaacattgggaggctctttattttctgcgtgctaagtagtaggaatataaatctgcactcagactgagctgtgcaaaggcattcataattgcaggcagttgcatcagagctcagagttccatctctaaaaaaaacattgtcttatgccccaaccttctccctgggttagtttttaatcctgtccttcctttttaaaacttctctaggtacaacctgtattctgtactatgtcatacaccccttaagttttaaatacatataattttcttaagcacagaataatttttcaaaggggtatgtctactcttgactttggaaagataccataaactttgtatttactgtcagtgtcttattgtgtgatattctcaaatcaacacttaaggttagcaggctaattttataaattgctctgtaaggtttgtctcagtt

SEQ ID NO: 53266 - DNA, 362 bp, Homo sapiens
aataaaaaaaatactttaaatgtgggataatgcactacttatactggaagctcacagacttggccataattagttcttgcttaatttttaaattttttgcaagtgttcttgtctcttcagtttcttctgataaattttctgatttcacacattaacatttgtagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccac

SEQ ID NO: 53267 - DNA, 376 bp, Homo sapiens
gcctcctttcgttcaaaccctcagcctaagctaaacaactgtgtttcaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaaagggcgcctgcccagtgcttctctgtacaccccgcgtcctcccgaggagccctttctagtagagatgctcttcgaagacagctctcatgctgccctgaccctgactctccttagctcttccaccacttaatcaatcaagggctaatcccatgtgcctgccatccccgttcct

SEQ ID NO: 53268 - DNA, 395 bp, Homo sapiens
aaccctcagcctaagctaaacaactgtgtttcaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaaagggcgcctgcccagtgcttctctgtacaccccgcgtcctcccgaggagccctttctagtagagatgctcttcgaagacagctctcatgctgccctgaccctgactctccttagctcttccaccacttaatcaatcaagggctaatcccatgtgcctgccatccccgttcctggggcttcttgtggtctgtcaatattgtcacaaa

SEQ ID NO: 53269 - DNA, 400 bp, Homo sapiens
cagatagcctggactgcaggcacgcgacaccatacctggctaattttttgtagagatggagttttgccgtgttgcccaggctggttttgaactcctgggctcaagtgatcttcctgcctcagcctcccaaagtgctgagattgcaggtgtgaaccaccttggctggggaggtcagttttaacttgccttgagattgactctttgatctcactgctgtatataataatttagaaacatttattcatcagtttacattagggtcaggagcctggagattggggttttagtcctagactgttaagtaagtatgaccttgacaagtgatttcactttttagaatcagttttcttgttggtaaaatgagagagttgaactagattgctacagtctcttctgattc

SEQ ID NO: 53270 - DNA, 5935 bp, Homo sapiens
gaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53271 - DNA, 5899 bp, Homo sapiens
gaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgaggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggcaagaaaaaaaaaaaaaaaaaaaaaaggttgggggggggcgagaaaggttaaaaacattggggggggggcaatggagagagagggaaagtgcaggaagcgggagaaggggggtttcacaaaagcggggggaggtgaacaagggtggt

SEQ ID NO: 53272 - DNA, 6071 bp, Homo sapiens
caggaatatgatatgagaacatagcctttgaatttctctctcaagtttgacttgaaaaatcagcctcagaaacatctttatcttaagatagatttccgttgctctcagaacgtctctcccctgaccttctgttattaagttcatggacatacagcattttagaattaggtgggggctccgaagtctgcgagtgcagctgtgcacagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53273 - DNA, 5885 bp, Homo sapiens
gaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53274 - DNA, 3716 bp, Homo sapiens
cggtgatgtgatgagtcgtgcgtgtgtcgcgtctacagaacaaaaacacgaaggagaaaaaagagaccaagagaaacatgcgaccatggggcttgtctgattataagacgatccgcgctcgtatgtcaatgacgcgggtatggaaccgtaacatcagggtgattagtgtagggtgaggtgcacaccagtcagtccagcactggttggatagtttaatcccgggcagtctctgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53275 - DNA, 3444 bp, Homo sapiens
tgctctgaagaaggagcttcaagagagaaaaaaggaaaaccaagaactagtggccagcaagtgcgacctctctttgatgctgaaagaggctcaaaataccaaaaagaatctggaaaaagaacacactcacatattgcaagcaaaggagagtttggatgctcaacttaacacgtgttgttccgagaagaacattttgctgagagatggcttgaacctgcaagaagagtgtcacaaattaagcaaggagatccaggaaatgcagcagtccttaatcctggaacaggaagccagagcaaaggagagcgagtcatccttgtacgaaaacaatcaacttcacgggaggatggtgctcctggagcaggaggtggaggagttaagagtgtgtatcgaggagctgcagtccgagaagtttgtgctacttcaagagaagagcaaatcagagcaagaactggcagagataatcgaggagaaggaactgttgactgcagaagcagctcaacttgctgcccatataaagactctgaaaagtgattttgctgccttgtccaaatccaaggcagagctgcaggaactgcacagctgcctcaccaagattctggatgaccttcagcggaaccatgaggtgaccctggccgaaaaagcccaggtgatgcaagacaaccagaacctcctggctgagaagagcgaaatgatgctggaaaaggatgagctcctgaaggagaaggaaaccctggcagaaagctacttcatccttcagaaagagatcagccagttggccaaaaccaacagccatatttcagccaatctcctagaatctcaaaatgaaaaccgtactttgagaaaagacaagaacaagcttactcttaaaattagagagctcgagactcttcagtcatttacggctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattttggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattctttttagaaacaaaaacacagacaacacaacaacaac

SEQ ID NO: 53276 - DNA, 3486 bp, Homo sapiens
gaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagtacgtgacgcgagagaatttccttgtgttgtagcttgcctgagctctgtgtcgaggcaggaagggtgcttagaaagcagcagccagtgggaaa

SEQ ID NO: 53277 - DNA, 2930 bp, Homo sapiens
gaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttggtaagtacctgttgggaatctgaatctcagggtttctggccatttcctgttttaaaaaatcctccagtaagaaatattgtagctgtttcctttctctttctaagtgttgattcaacttgagtgtattagttattggctgataaatattgtcctttgaggggaatcggatcaaacccaaacaacaaaggtaggtatactttttttttctaaaacgtggga

SEQ ID NO: 53278 - DNA, 484 bp, Homo sapiens
cctgaccaaggtccaggcgaatgtttgcgggcttcagaaagcccaggcgatcgaaaggcagcttgtgtcactagccaaacgctctgcctttacaatttggtgccctctgtatctctccattttggggccgctgacctggcaggctgcacggagggttacaaactcacagggctccccacagagcatccaggcaaggatcctgcctggctgaggttccctcacatataaaatggggatggccgtgccaacacctgtgccaccccctccctaacagactgccccgaaagacacaggcaatggtgccactgatgggctttgtgggcaacagcacagcgccactcaaatcccagagtgctgctaattaagaccaggtgaccccaaacaaaatgcctgagccaggattagtcttagtcactgctgttattattgttatactaaatccccttttagacatgacttcctgacccttacattttcagctgtc

SEQ ID NO: 53279 - DNA, 462 bp, Homo sapiens
gacatatatgagatcatatagatgggattgaaaaattcaatcctcagctgggcgcggtggctcacgcctgtaatcccagcacactgggagggtgaggcaggcggatcacctgatgtcgagagttcaagaccagcctgaccaacatggagaaaccccgtctctattaaaaatagaaaattagccaggagtggtggtgcatgcctctaatgtcagctacttgggaggctgaggcaggagaattgcttgaacccaggaggcagaggttgtggtaagttgagatggtgccattgcactccagcctgagcgacaagagcgaaactctctctcaaaaaaaaaaaaaaaaatccaatcctggctgggcgcagtggttcatgcctgtcatcacaacactttggaaggccaaggttagaggattgcttgagcccagaagttcaagaccagcctacgcaacatggcaagaaa

SEQ ID NO: 53280 - DNA, 312 bp, Homo sapiens
atcgatgtccctatcaatgttttgagagtttggggaagagccaattaaaaaagcatttagctgggcctgatggcacatgcctataatcccagcaacttgggaggctgagaggcaggaggatcacttgagaccaagagtttaggaccagcctgagcgacaagagcgaaactctctctcaaaaaaaaaaaaaaaaatccaatcctggctgggcgcagtggttcatgcctgtcatcacaacactttggaaggccaaggttagaggattgcttgagcccagaagttcaagaccagcctacgcaacatggcaagaaa

SEQ ID NO: 53281 - DNA, 2383 bp, Homo sapiens
cgcggaaccgcgggtgcgggcaggaggcggcggcagcagcgggaccgagcagcagcggctatgcatccaagtgcggctgggcagccgcggcacccctgaggcccgggaggggctccgggaacacagcgcggaggggacgctagtcgcggaggggacgctagtcccggagtgcgaggaagaggtgtagtgtccagagcggcggcggcggacgtgcgcacggagctgaggagggggcttcggagcgggactgggacggggggggcggctggcgcgagcagccctgggggtggggggcggggtgggccggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtactagtgaacattgggaacaactttgattcagaacgcagcactttcatcgccccgcgcaaagggatctacagttttaacttccacgtggtaaaagtctacaacagacaaaccatacaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcacgacttgaaacttcctacatgttctctaactgtatctgggtaaaaaggtgcgcgccagctgtgggacaactttgtccatttccttattaggagaaataaatttcgcttagctctgcgcactcccatttccaaaaataaactcgcctcccccattccagttgcagtaatcaagaaagagactgccttgtcattgtttcttatcccccaacttcatgttccctgcaatttatttaaagaaactttgtatttcactacataatctgaaatctttctccctagccccctctgaatccttctgcctactgaaatctgatatattacacacccccaaccttttttttttcagtttggaaaggggtaaagttttgttgttgttgttgttttgttttggatggggaaggtagttttaatttggcaagtgttgctcttcttaaaacactgctcaaattaattagctgaagatacttagtatcctcggctgcttgttagcagagaaaggactcaccttagtggtgactggtttaaaaaatataaatatatatcatttgtacacgaagaactcttcccagtggaaactggctgtgtttccgtatttctatgttctattcggagtgatcgtgaaatctaaggctgcttgatgttctgatgcttgtcaatgccgtcgtgctctgtgactccacgaaacgccaaggagcttcttccggacgcctcctcttcctctgtaacatacgtgtgaatagtcaaggtttaattttgctttaatctaataaagtcgaagtgggacttttatttttctgaaacagctttctaaaatccgcatcttccccagctgcgaggttgggggtctggggtgccaaagggcgaggttccgaaaggcaggagacttgggggaacgcaaccatagaaaggcctgggcgcgagggcttccttgcaaagccggccttgcgctccttcctgcgccaggccggggaccagcactgcattcgcctgtgttcacagctttggcggaaacgtaagaaatgtggccgaaatcttgctaggccaggcgcggccgccggcccaggagcgaagtttgatttttttctttgcattccaaatgcatcaggaatagtcccagtttgaggacccaaacgaccctgcctggagcggcagactcctcaggccttctgtccccggatgtctcccaccgcgtccccctcgcagttcccgaagcagcgtatgttttatacaccgcctctgaatccggagtccacccgccgcatactcgggcgcccaggacctatgattccgctcattcacaggactttattcaagaggttcgtccaggagttttgattgtatcggaacataatgtgaaagcaaaaatgaaataaacgacttcgttttaagtctgaaa

SEQ ID NO: 53282 - DNA, 2710 bp, Homo sapiens
  misc_feature (2264)..(2264): n is a, c, g, or t
cgcggaaccgcgggtgcgggcaggaggcggcggcagcagcgggaccgagcagcagcggctatgcatccaagtgcggctgggcagccgcggcacccctgaggcccgggaggggctccgggaacacagcgcggaggggacgctagtcgcggaggggacgctagtcccggagtgcgaggaagaggtgtagtgtccagagcggcggcggcggacgtgcgcacggagctgaggagggggcttcggagcgggactgggacggggggggcggctggcgcgagcagccctgggggtggggggcggggtgggccggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtactagtgaacattgggaacaactttgattcagaacgcagcactttcatcgccccgcgcaaagggatctacagttttaacttccacgtggtaaaagtctacaacagacaaaccatacaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcacgacttgaaacttcctacatgttctctaactgtatctgggtaaaaaggtgcgcgccagctgtgggacaactttgtccatttccttattaggagaaataaatttcgcttagctctgcgcactcccatttccaaaaataaactcgcctcccccattccagttgcagtaatcaagaaagagactgccttgtcattgtttcttatcccccaacttcatgttccctgcaatttatttaaagaaactttgtatttcactacataatctgaaatctttctccctagccccctctgaatccttctgcctactgaaatctgatatattacacacccccaaccttttttttttcagtttggaaaggggtaaagttttgttgttgttgttgttttgttttggatggggaaggtagttttaatttggcaagtgttgctcttcttaaaacactgctcaaattaattagctgaagatacttagtatcctcggctgcttgttagcagagaaaggactcaccttagtggtgactggtttaaaaaatataaatatatatcatttgtacacgaagaactcttcccagtggaaactggctgtgtttccgtatttctatgttctattcggagtgatcgtgaaatctaaggctgcttgatgttctgatgcttgtcaatgccgtcgtgctctgtgactccacgaaacgccaaggagcttcttccggacgcctcctcttcctctgtaacatacgtgtgaatagtcaaggtttaattttgctttaatctaataaagtcgaagtgggacttttgaaaaacaaaagaaaaaaaacaaaaaaaaaaaaaaaaaaaaaaaaaacaaaaaaaaaaaaagaagaagacaaacaacacgacggagaagcgtcacataatagcgcgacctaccaagtggacgcacgaggactagagtgagagagccagcagcatctagggcagcgccgacgttctaccgatcattagtcatacggcgtccaatacacggaaagtctcagaaggatcacctgctctaagatccacgggccatgctccaatactgtctagaggttccaagatacgtcggctccatcgccgtagaagagcacgactcgacgacacagtttcggaacgaatgaagccgatgccgtacactaatgccatgcgttaatagcgcgcgacacactcgacacgtcacacgtggccatgacaccgcaagcgacttccctgcgacacaacacggcctacaaggaacgagtcactgatcacaagtcgagaaacatgtatcncacagcacacatcgtaaactaacttggtagggtaaaccataacacgctgcgagacgtgtcgtacacatgagtcaatatccccgtcacatatctagttctcgcaatccagacatcactcatatatattgaactcagacccactcttgcattaactatagacatccacactcttgcctcttgctacaaccaattatctgtcacatacagactcaacgataatttatcacttcctaagccatacagacttaaacaattaccactacacataataaccaaacatacacaatttctctgatacaatcataatttatcaccctttatattataaaaccatatataccccacaaccacatatagtataactcattatactacatatatacacaatcaatatcacaatttattaatattcacacacaacaattagcaatcacaaatacaacaaa

SEQ ID NO: 53283 - DNA, 4327 bp, Homo sapiens
  misc_feature (56)..(56): n is a, c, g, or t
cgagatcccggggagccagcttgctgggagagcgggacggtccggagcaagcccanaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttagaattccggcggagagaaccctctgttttcccccactctctctccacctcctcctgccttccccaccccgagtgcggagcagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaaacaagcaaacaaaaaaaaaa

SEQ ID NO: 53284 - DNA, 4284 bp, Homo sapiens
  misc_feature (56)..(56): n is a, c, g, or t
cgagatcccggggagccagcttgctgggagagcgggacggtccggagcaagcccanaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttagaattccggcggagagaaccctctgttttcccccactctctctccacctcctcctgccttccccaccccgagtgcggagcagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaaacaagcaaacaaaaaaaaaa

SEQ ID NO: 53285 - DNA, 4324 bp, Homo sapiens
  misc_feature (56)..(56): n is a, c, g, or t
cgagatcccggggagccagcttgctgggagagcgggacggtccggagcaagcccanaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttagaattccggcggagagaaccctctgttttcccccactctctctccacctcctcctgccttccccaccccgagtgcggagcagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctaattttttttttttttttgcttctcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaaacaagcaaacaaaaaaaaaa

SEQ ID NO: 53286 - DNA, 4308 bp, Homo sapiens
  misc_feature (56)..(56): n is a, c, g, or t
cgagatcccggggagccagcttgctgggagagcgggacggtccggagcaagcccanaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttagaattccggcggagagaaccctctgttttcccccactctctctccacctcctcctgccttccccaccccgagtgcggagcagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaaacaagcaaacaaaaaaaaaa

SEQ ID NO: 53287 - DNA, 798 bp, Homo sapiens
gaactggctttacaaaggttaggcaacaagaacagagcttaaagatcataaggtaaagaacagtaacataataaatctagtttgaaaaacagctctaatccatgaacccaattttgaaagtaaccaactgaacagatcaaaaagtctagatgtatttgatgaacttgttggaaccaggtgacttgttttttttaatcttctataattgtgtttttacttttccagaggaatttatccatgtgtagtaagtagaggcagcaaatgcataaatgcctccttgttcagctacttaagtaattcagagcaatcctaattcactttagcaagagaatctagtgaagtctgttgagatgcaatggcttaagctgtggagtcagctacagacccaattagtcacaaatttttgaccactgtttataaggggctaactgatccaagggaaaaaggatctaacaactgggaccatccagttggatgcatgtttcttggtaaagtatctcttttaatatgatggtgtaagttaagaggtgacaaccaatgttcagattttgctaatttaaatccagaaatatctcaaaccacactggtattttttctttaattgactgagacattatgttgtccatgcatatggttgactactgaatccccctcaaatgaaactgtatcttgatagagcacaacaggtaattccatctacagtctgtgtgtattcatagttacttgtagggaggtgacagcaatacttatttaaggttctattattaaactactatattgttggaagacataaaaaat

SEQ ID NO: 53288 - DNA, 955 bp, Homo sapiens
gtgttgtttgatgactctgcatgtgaccagtagtgacattttactcactgaggctcatattgaggttaagcccgaggtccattggccttgctgagatcgtgtttagaacacagcactgtgcagtaagagactcctataactctatcaaatttgcatttggaggaattgtaaagagcctctgttacctcctaggtgaggcagtccaggaaaacagttgctagaaggagctatctgcagaaatagacagttgtggtcctttcatgttttaataattgttccctggatttcaaggagtcagtccaaaatccccgtaatagattttagtaacgttcatggaatctcagtttgcacatcatgagacctttagtgtggtgtttactgtcttcaccttaatatactttgtatccatgagcaaccttgctacagtcatgcaaagatgattattttttattcagcaataattagccacagtgttgagcacccagatgccttcctgcagcagccccccttttctccccagccaacatctgcaactgtgaacagatttccatcttcagccttggtggttggaaagaaatgtaagtcacctttttttctggttggttctggggcagatgccaccaggctgcagaggcagtctgtgtctgtggggctcaccagggcatgagttctgctcccaggaaagagattcttgcaggattttgtctgtggttctaaggagacaagtaggtggcacacaaaaacagaaaatgaaagaacccatccctccaaaaccacacacacaaagccaaaaggaaaaaaaaaagcacataattatcatgtaggcactgttgcagctaatcctgattttggcctcaattctgaacaagttagctggtttagacaaaccccttattaggtaatggattgttattcattcctccccttctcctagtcatttactccgtgagagctg

SEQ ID NO: 53289 - DNA, 231 bp, Homo sapiens
attctctctccctgtactccaaaagtcttcctgagtatacctagcattaggttttactgttttattttcttaattgatggctagtatttaagaacattatctcccttctgtattatgtattttaaataagagtatttactgtcttgtatatacttgtattgtcttgtatatacttgtcttgtaagagtatttactgtcttgtatatctgaatgggtcacatgtagtgcaag

SEQ ID NO: 53290 - DNA, 637 bp, Homo sapiens
caggtctcaacagtggggtaattcacttagagctggaggcacatagaagggaagtgcacatgtggcctgtgctagacactgtgggagcagcagaccgtgacagttctcatcactgttacaatttctctaggacagttagaggagggctcatcacagcattcaattacagtctacgttttccttctttcaaacactgcagggccaatttcccctcattcagtgatacctatgtggcacacgcacacatgcacagcagataagactttggacattttgacagagaatttgcagatgcagctattgtcctctatcttggtggctgttagaagaggcacacaggcctcagcataatttgcataagagacgtagacaatgttcacactctgttcctcttatctgcttctcataagaaggaagtgattatgtgggggtgtcatgtggggtcttacaccgtgttggtcagggtctgaaagaagcagaattgtactcaggtggctcaactaaaaagacttcagttggctcagcgtgctggctcatgcttgtaatcccagcactttgggaggctgaggcggccagatcaccggaggtcaggagtttgagaccagcctggccaacatggtgaaaccctgtctctact

SEQ ID NO: 53291 - DNA, 313 bp, Homo sapiens
gtcctagcacatcttcatctccatatgtgagatttatatttcataaaacttatatatgatgaagtatttaaattcaacagaagctacattcacaaaatggtaagccttgctttgggaatgtcccctattaacatgcctttctagggcttgctcttcccgtacagcaagctgagtagtactggcactgccactcaaacaagtttctgatcataatgaagaatggctgacttattagttgtgctatcctgggatgtcaagcattgttaaatttgaaaatgtgaactggacatagaaaagtggtttatttcattta

SEQ ID NO: 53292 - DNA, 323 bp, Homo sapiens
gtgaatgtaaatcttctgatgttactttaaaacctaatgtcaagatgtcagaaaagtttcaatgcacttgtctttgttttaccatctaaagacttttctaaattggtttgtcaagaggataggaatcagctgatattcctgtaatgtttggttaaaagatgtaaggaaagagaagcaaattccatgaatccattttgatttgattctttcctttatgttgccccattctggatcacgtttcttcttttccacttagaatgtactgacctgccatctccttccctccctgtgtttctgtacccttgggctgttccgttggtgtg

SEQ ID NO: 53293 - DNA, 415 bp, Homo sapiens
gttgaactaagaaagttcctcttcttccaaataaggttttacttagagactttcagtcccacttaaaacttcaaagcaataagcttcatttcacagcttcactaaatgaaacctaatggtagacatgcctttgactagacataaagtaagcattctttctagagaaaataaatagaaagagaggtttctttctatttccttatcagcttcacctctttcttaggaaatgattgctcgtctgggacagcatttgtcatgagtttgttttcactttaaaggcatgaaggggagagatgaccaggggagtgatacccatctggctcatcttcaagggattgcgtagggagttggagctgtagaggtttcactggcagaaagccagtattgtccaagaagcatcctgagaacatgtaat

SEQ ID NO: 53294 - DNA, 491 bp, Homo sapiens
gcagcattccttatatccttataatctaataatctttatctgttcttatttattttatgtatgttcttctaaccttgcaccccacaaggacatggactctattgacacactatccctagcactcagaagaatgcctgacacatagaagttgatttgcaaatgtttgttgaaagaataagtgattgaatgaatgaatagaaactattttccttatctatgtgccaatagtagcccaggtagaaaatataatggtgatgaaaagagattgataggaacaaaaattattaaaaagagcctaggagtaaactttaaaaatacgtaggacctacattcattcattgactcagcagtctatatcaagcacttaactctgccaggcactatgattttaaggataaataaggcaaacatgatccttgcttgttttgaacttagaaaaatacaaaacttatacctgggagacacagggatgaagacatcatttctcctaa

SEQ ID NO: 53295 - DNA, 241 bp, Homo sapiens
ttgaacggggtgcttttttaacaactgagggaaaataaagttttggaaatgttggtaaggattagagtatacacagatacatggtaataaatgtcaaagatgtgggaggttatcctgcagcaaatagaatgttgctaaagatttatgagcagggtaatgaaacattgagaggagagatacagtaaaattcatctttattccttggccagtttggttgaatcagggaaggagaaatgagagg

SEQ ID NO: 53296 - DNA, 329 bp, Homo sapiens
catcaaagtacctgaaagcagatctacatcttctgacttcacttactcaatttttattaatccatagatcaaggtgcattattccacaaattatgatcctctggcttctacttataccagtgtactaaaatgtcttttgatgagatcaccaaagagttcactcatgtcatactgcaggccctaatcttagttattaccttatttgaaagcagatctacattttctgacttcacttactcaatttttattaatccatagatcaaggtgtattattccacaagttatgatcctctggctcctacttataccagtgtattaaaatgtctttt

SEQ ID NO: 53297 - DNA, 341 bp, Homo sapiens
  misc_feature (1)..(1): n is a, c, g, or t
  misc_feature (3)..(3): n is a, c, g, or t
  misc_feature (6)..(7): n is a, c, g, or t
  misc_feature (86)..(86): n is a, c, g, or t
nanttnngtggcacttacatgaacacccacgcactctctcaatctactaattcccaaccttccactcgcactcctccacttttgcntcctagcccaaacacctgaaccatgagtaagtaattccatgcaatttcagctcggtctctgaaaatactcactttactatttgtctcatcatctttcctgcagcggctgctgcagactgctgctttcagggtccttcttggtatcctttactgtcatcacatcagcttagagagacgaggccaaggtgttcttcctcgccatgagcctcacctgcccttctccaaagctaaccacttgacttacaccatgaattc

SEQ ID NO: 53298 - DNA, 1791 bp, Homo sapiens
atcgctgcagaagcaccccagcacagggggtcttcacatagcccccttcccacttctgcccctagttctagggctggccttcctccactggctatgacattggacttgacatcaggatggcggctctggacacccattcaacccttcagactccctcctggcagctgtagggaaggaaccattctcctctgctctgtcatggatggatgcacagccccactgcttccaaactctgcctgtgtcccatgtggctcaggacatgagcttaacccctgcaaagcctataccacatcccacagcccgggtccccagtcaagcacttggatgcggcagtgatgttcatcgctacgtgagtttctaaagatcactcccaatttttctactttcctcatccttggcagctcgccaacaggtgcagtcagggggccacacggaacacccccatcccatgttccccccagttcttcccatcctgacccttgggattccaagatgggagcaagaggagatcctgaggctctgcctagggacgaggcctacagttctgccatgtctgtaggttgttgtttaaagattattaattcgaatttagcaatacgatctctaagtggtgccatgaattaaagatgccacttcgggctttcagtgcttctcagcttttgggcaaagggcttgtgtcttcaggggcagctcagctttcctgagtcctgactgctggcattcgtctgcatttgcctgtgcttctgcgagtcggacctcaagctgccaacactgcatgtggataaatccagttttcccgggccagcatgcaaaatgaagaggactccatctaagctgagaagcatggcctccccagagcagcctgcggcctccaagccttcctggcccaggcaaatgccagtgtgcaccaggctggctgctgggggcaggtctttggaggggagcagcatttccagccttctgaacatagttaatagtaatgacagccgtaacactaacgcgctctgcaattcgccctgcccagccatcctcggttgccaagattgcctgtgcctgcctgacaaaggaagagaatctccgaatgtgtatctttgggcccaccctagggagaggtcggggtcaccaggctacatggcgacatctaggcagctccgccttgcccagcctccttgccataatcctaatatattggtgtcctctgctcagaggggactgtcatcatggtgggaacaggctgtgcctccccagggactctgcccatgttcccagggcctcatctgtacactgtgaaattaactggcatcctggtgggcccaagggttttcaggactgggggccaatgactcaccccctccttcctcctcctgatccctatctctagctcttatcacagattttgaacaattgtctgtgaggttaatgatggtttcagagggaagcccttttcctccctgagactgtgtggggttcagtcagcctgctgaaattgcttccacttattacccatccttcctcttaaaaaaaaaaaaagcccaccaagttagtattctctgtagctctcagacagctacaagtgttcctggcatatttaccaaagtacaagaaatcattacattatttacggtctcagactacatcagggttgggggagctcctggtggggatggcagtgggtgtcgatgatatgtccacggctgagcaggtcttgtatccgaagcttgaagtaaccatgccaccatttatcatcaaatttgaaccttttaataaaattaaacagcctgaaaaatgttc

SEQ ID NO: 53299 - DNA, 384 bp, Homo sapiens
gtcacaacttgggagctcagtgcacgtatctaggtgactgggaagagggtggcaccaataccagcaacagagcaatgaggaagaggaaccggtttgcagcagaagagaaattttaaacgggttgcatttgagcggctttggaacatccacatggagataacaacagagagttggaaatgctagtctgaaccttaaggaggaaagctctacttttggcagaagaactggaacgtatcccctcttcctggagtgcctttccctcagctgtctcctttccggtcctcagtaaggtctctgctcaagtaccccttcatgccctttcctgccaccctacaatggtgcccctgtcacacacaccaccgccctcgctctgctcagttcttc

SEQ ID NO: 53300 - DNA, 1286 bp, Homo sapiens
tccggccaccgccgcgtggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttc

SEQ ID NO: 53301 - DNA, 841 bp, Homo sapiens
  misc_feature (711)..(711): n is a, c, g, or t
  misc_feature (718)..(718): n is a, c, g, or t
  misc_feature (726)..(726): n is a, c, g, or t
taagcatataattataataacataaaaatgtacatgctttggtagggtagattttaataagattttaataatattggtaaggagccaaattacagaataccctagaatgtggaatacaaaatctcagagacaaaataaaaactcatgaaaatataagagcactttaaaaaggtaataatctttaggataaagaaagccttttctcaacacaggtactgagcatgtttaataaaaattaaatgagattaaagagaaggggcacagccacacgctccccgccccgcggtgattaggaaggtgatgcttgtgtaggtgaaagcatggagccagggcacagaagagctccgaacaccaacagtgctgcagtaagctgtctccacgtgggtggaatttctcacaatccactcacgggataggaattaattttctctccagttgcagaggggccttgtacatgaactgcgttggcatgcggaggaggggcaacacatccatgttggggacccctcccatccacagccccagctgccaccacggcagggcatgggctttgggggcaacaaggagagacaggctgtctcctctaggaacaactcattattcagctaaacgaaatggaagagctccatgtgaccaacaaacccaaattgagccaaaacaacagcgtccccacccccagagggataatgtgcacaccctgtgtgcagtggnagagcangaatggangaattattcttggttcagtttaactcctcggcctgcaggggaagtgtgcgcacctaattctggatttcggggagggggggggggggttttcctcaaattttgcagacaaaccctt

SEQ ID NO: 53302 - DNA, 700 bp, Homo sapiens
agcgggagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcatacttgtcgttaaaaaagccttcctggccgggcatggtggctcacgcctgtaatcccagcactttgggaagctgag

SEQ ID NO: 53303 - DNA, 153 bp, Homo sapiens
gcggccgcctactacactactgctcgaattcaagcttctaacgatgtacggggacatgagtttttattttgtctctgagattttgtattccacattctagggtattctgtaatttggctccttaccaatattattaaaatcttattaaaatct

SEQ ID NO: 53304 - DNA, 1942 bp, Homo sapiens
aagatgctaggctggtactggtctgggaatttttgggcatccttccctgagcacggcggcggcggggacgagcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53305 - DNA, 2010 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53306 - DNA, 1900 bp, Homo sapiens
ggctggtaccggtctggagggtttgggatgcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53307 - DNA, 2698 bp, Homo sapiens
tccggccaccgccgcgtggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgggacccaccccgtttttgtgttgtcttccttccttgcccttgtttcattccttttgaaagcgaccactcccctgaagtcctaggacccccttcgtgggctctccctgccgtagacagtctctgcttgcccctggtaaactacacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53308 - DNA, 2435 bp, Homo sapiens
tccggccaccgccgcgtggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53309 - DNA, 1804 bp, Homo sapiens
aagatgctaggctggtactggtctgggaatttttgggcatccttccctgagcacggcggcggcggggacgagcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttat

SEQ ID NO: 53310 - DNA, 2563 bp, Homo sapiens
  misc_feature (2433)..(2433): n is a, c, g, or t
  misc_feature (2440)..(2440): n is a, c, g, or t
  misc_feature (2448)..(2448): n is a, c, g, or t
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttgtactgagcatgtttaataaaaattaaatgagattaaagagaaggggcacagccacacgctccccgccccgcggtgattaggaaggtgatgcttgtgtaggtgaaagcatggagccagggcacagaagagctccgaacaccaacagtgctgcagtaagctgtctccacgtgggtggaatttctcacaatccactcacgggataggaattaattttctctccagttgcagaggggccttgtacatgaactgcgttggcatgcggaggaggggcaacacatccatgttggggacccctcccatccacagccccagctgccaccacggcagggcatgggctttgggggcaacaaggagagacaggctgtctcctctaggaacaactcattattcagctaaacgaaatggaagagctccatgtgaccaacaaacccaaattgagccaaaacaacagcgtccccacccccagagggataatgtgcacaccctgtgtgcagtggnagagcangaatggangaattattcttggttcagtttaactcctcggcctgcaggggaagtgtgcgcacctaattctggatttcggggagggggggggggggttttcctcaaattttgcagacaaaccctt

SEQ ID NO: 53311 - DNA, 1979 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttgggggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53312 - DNA, 1841 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagcagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttat

SEQ ID NO: 53313 - DNA, 1567 bp, Homo sapiens
  misc_feature (1)..(1): n is a, c, g, or t
  misc_feature (12)..(12): n is a, c, g, or t
ncggtgatctanaggatcccagacgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53314 - DNA, 2080 bp, Homo sapiens
tgtattggtggtgctggcaggcctgtgggccgagcagtccgggccccacactgcagcctcctctgccttcagaggctgatggagcagcggccttcagtgcggggcccttgggattcctggctgccgagttagcgctgcctgctgagatcaggacaagaaaacagatctgccctctgtagagctggtttgaagtggtctgcaaagccatgctgggaagcacagtggtgcccacctctgaatttgccagcagcccccactccctccattagtcctcccactagtaagagaagctaccttgtgcatactgccttgattacctgtagtaagggaaattggttaatcggatcaaggcttgactacttgacatgttttccctttgcatttgtttaaaaaaaaaatccataaagactggagggaagattagatagaatccaccctctgctgtattagaaagcagcagatatgtatttcagtgactggacactgtctgcaagcacactcagaaaaggtcattaatcatagacgctgaaagtgctccagctcgttccgcctgtcttttgcagcatctgtaggtgcgtacactaagggagctcccattgttaccttacaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53315 - DNA, 991 bp, Homo sapiens
  misc_feature (29)..(29): n is a, c, g, or t
cggtacccccaccacctcatctgcacctnatctgcagcaaatacttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53316 - DNA, 904 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttcaaaaaaccacaaagtcgagc

SEQ ID NO: 53317 - DNA, 778 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatcttttccccccccaagggtaaaaaaaaggggggtaaatatttttt

SEQ ID NO: 53318 - DNA, 1038 bp, Homo sapiens
tccggccaccgccgcgtggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgggacccaccccgtttttgtgttgtcttccttccttgcccttgtttcattccttttgaaagcgaccactcccctgaagtcctaggacccccttcgtgggctctccctgccgtagacagtctctgcttgcccctggtaaactacacccaacatgagtgaagtttcctgcaagaaacgggacgactatttggaatggccagagtattttatggctgtggccttcttatcagcacagagaagcaaagatccaaattcccagcgcgcgatggccatgatgttggagttacgaataccttttgcacgcggaacgtaccaggtgcct

SEQ ID NO: 53319 - DNA, 224 bp, Homo sapiens
  misc_feature (6)..(8): n is a, c, g, or t
  misc_feature (10)..(10): n is a, c, g, or t
  misc_feature (12)..(12): n is a, c, g, or t
  misc_feature (16)..(17): n is a, c, g, or t
  misc_feature (20)..(20): n is a, c, g, or t
  misc_feature (22)..(23): n is a, c, g, or t
  misc_feature (27)..(27): n is a, c, g, or t
  misc_feature (30)..(30): n is a, c, g, or t
aggggnnntntnttanngangnncagngcntgggggggggaaggggggggggtggcctaaagattattacctttttaaagtgctcttatattttcatgagtttttattttgtctctgagattttgtattccacattctagggtattctgtaatttggctccttaccaatattattaaaatcttattaaaatctaccctaccaaagcaaaaaaaaaagtcgacgc

SEQ ID NO: 53320 - DNA, 884 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttc

SEQ ID NO: 53321 - DNA, 2033 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53322 - DNA, 2558 bp, Homo sapiens
tccggccaccgccgcgtggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53323 - DNA, 2156 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcgggcactgccgccctgcactgtagcagatgcctaaataaagtgtggagcctgaagcagaagttttgggagatgcttgccttcctttagaccacattcctcgcctttctcaagatttctccgtgggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53324 - DNA, 2064 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatctaccctaccaaagcaaaaaaaaaagtcgacgc

SEQ ID NO: 53325 - DNA, 1897 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccagtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53326 - DNA, 2509 bp, Homo sapiens
  misc_feature (2379)..(2379): n is a, c, g, or t
  misc_feature (2386)..(2386): n is a, c, g, or t
  misc_feature (2394)..(2394): n is a, c, g, or t
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagcagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttgtactgagcatgtttaataaaaattaaatgagattaaagagaaggggcacagccacacgctccccgccccgcggtgattaggaaggtgatgcttgtgtaggtgaaagcatggagccagggcacagaagagctccgaacaccaacagtgctgcagtaagctgtctccacgtgggtggaatttctcacaatccactcacgggataggaattaattttctctccagttgcagaggggccttgtacatgaactgcgttggcatgcggaggaggggcaacacatccatgttggggacccctcccatccacagccccagctgccaccacggcagggcatgggctttgggggcaacaaggagagacaggctgtctcctctaggaacaactcattattcagctaaacgaaatggaagagctccatgtgaccaacaaacccaaattgagccaaaacaacagcgtccccacccccagagggataatgtgcacaccctgtgtgcagtggnagagcangaatggangaattattcttggttcagtttaactcctcggcctgcaggggaagtgtgcgcacctaattctggatttcggggagggggggggggggttttcctcaaattttgcagacaaaccctt

SEQ ID NO: 53327 - DNA, 1852 bp, Homo sapiens
agcggagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaaatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 53328 - DNA, 1966 bp, Homo sapiens
tccggccaccgccgcgtggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcaacgctccacactcatgctcagagcagcattattcacagcagccaggaggggacgtcgcccaggtgttcctcggtggatgaatggataaagaaaatgtaaacacacagtggaatcttactcagccttgaaaaggaaggaaagtccatccaacacatgctactgcatggacgaactttggacagtgagctaagtgaaaggagacagtcacaaaaggacaaataccagatgatcccacctgcgcgagatgatagacagagtctcactacattgcccaggctggtctcaaactcctcgcctcaagcaatcttcctgttactggaaaggagacctgatccagaccccaagagagggttcttggacctcacacaagaattcgagatgaatccatagagtaaagtgaaagccagtttattaagcaagtaaaggaattaaagaatggctactccataggcagagcagccccgagggcttgctgtgcccaattttaaaggtatttctcgatgatgtgctaagtaagaggtggattattcaggtcttcgtcttttagaccatgtagggtgacttcctgatgttggcatggacttgccatcacggcgctgttgagagtgtatagcaatgaggacgaccagaggtcactctcaattgcctccttgcttttgcggggtttagccggcttctttaacgaacctcgtttatgcagggcctc

SEQ ID NO: 53329 - DNA, 1261 bp, Homo sapiens
tccggccaccgccgcgtggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgggacccaccccgtttttgtgttgtcttccttccttgcccttgtttcattccttttgaaagcgaccactcccctgaagtcctaggacccccttcgtgggctctccctgccgtagacagtctctgcttgcccctggtaaactacacccaacatgagtgaagtttcctgcaagaaacgggacgactatttggaatggccagagtattttatggctgtggccttcttatcagcacagagaagcaaagatccaaattcccagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatctaccctaccaaagcaaaaaaaaaagtcgacgc

SEQ ID NO: 53330 - DNA, 2897 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53331 - DNA, 874 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctca

SEQ ID NO: 53332 - DNA, 444 bp, Homo sapiens
  misc_feature (6)..(6): n is a, c, g, or t
  misc_feature (25)..(25): n is a, c, g, or t
  misc_feature (27)..(28): n is a, c, g, or t
gcagcncctactactactaaattcncnncccgtcgacagcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtgg

SEQ ID NO: 53333 - DNA, 332 bp, Homo sapiens
  misc_feature (11)..(11): n is a, c, g, or t
ttattattaantccgcccgcttcaccattacaacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtgg

SEQ ID NO: 53334 - DNA, 740 bp, Homo sapiens
ggagagagaaagggggacgtggccctgagctgtgggccgggccacccgccactacagagccctcactccagccccagctgcaggtgagccaccctcatgcctctcctcctccccctgctactccacactcctcagatgcccccgtggcctccctcctttttctctcccacactgtatcacccctggcttcctctctgctgtttctccttctctctctgacttcccgcatccttttctcatttgtctatttctcactcccttcctggttctgttctttctcccttcctcttccccatgtctatttcttgctgtctctgtctcttctttgctcatcctaattctcactgttctcccttctgtttttgtcattcctctgccattttatgctctctcttttccacttcgtttctttcagtttctgtctctgcctctctcttttctgtctccctgtgtctgtgtctcccccgtctctgtctctgggtctctctgtggccatctctgtcaccgtgtgtctcaccctgcatctctttgcctgtctttctctctgggtctctgcctcagcccttcctcatcactactgaacacaccccgtgagggtgggtggggagcacccagaaaaaggaaggactttaagctcaatgtgtgtgcatgtgagggggtgcctgtcattgcacagcactctctgcaggacatccctccaccctggggagacacagggagggctgctttcagctgtagcc

SEQ ID NO: 53335 - DNA, 329 bp, Homo sapiens
cagccccaaactcaccacctggccgtggacacctgtgtcagcatgtgggacctggttctctccatcgccttgtctgtggggtgcactgacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtgg

SEQ ID NO: 53336 - DNA, 514 bp, Homo sapiens
agggcgtgaggaggagcgagggggctgcatggctggagtgagggatcaggggcagggcgcgagatggcctcacacagggaagagagggcccctcctgcagggcctcacctgggccacaggaggacactgcttttcctctgaggagtcaggagctgtggatggtgctggacagaagaaggacagggcctggctcagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgtgctactttgccttttgcaaacttattttcatagatga

SEQ ID NO: 53337 - DNA, 3262 bp, Homo sapiens
ggagagagaaagggggacgtggccctgagctgtgggccgggccacccgccactacagagccctcactccagccccagctgcaggtgagccaccctcatgcctctcctcctccccctgctactccacactcctcagatgcccccgtggcctccctcctttttctctcccacactgtatcacccctggcttcctctctgctgtttctccttctctctctgacttcccgcatccttttctcatttgtctatttctcactcccttcctggttctgttctttctcccttcctcttccccatgtctatttcttgctgtctctgtctcttctttgctcatcctaattctcactgttctcccttctgtttttgtcattcctctgccattttatgctctctcttttccacttcgtttctttcagtttctgtctctgcctctcacatgatcacactcctgttttctaactcactgtctgtatttcaccacgactatatctccccgacccctgtgcttttctcactgtttctttttcttccctttggagtctcccttatcctcccctgatccatccctttccccattttctctctcctcatgcatccacccccttcctccccaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53338 - DNA, 3003 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggcataattcacccattcctgtgttgagcacatgcttactgggcacctgctacgtgaccagcattgccgtagaccctgggaagcagcagtgaacagtcaggagctgtggatggtgctggacagaagaaggacagggcctggctcagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53339 - DNA, 2774 bp, Homo sapiens
ggttgtggggggagtgacgatgaggatgacctgggggtggctccaggccttgcccctgcctgggccctcacccagcctccctcacagtctcctggccctcagtctctcccctccactccatcctccatctggcctcagtgggtcattctgatcactgaactgaccatacccagccctgcccacggccctccatggctccccaatgccctggagaggggacatctagctcagagagtagtcctgaagaggtggcctctgcgatgtgcctgtgggggcagcatcctgcagatggtcccggccctcatcctgctgacctgtctgcagggactgtcctcctggaccttgccccttgtgcaggagctggaccctgaagtcccctccccataggccaagactggagccttgttccctctgttggactccctgcccatattcttgtgggagtgggttctggagacatttctgtctgttcctgagagctgggaattgctctcagtcatctgcctgcgcggttctgagagatggagttgcctaggcagttattggggccaatctttctcactgtgtctctcctcctttacccttagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53340 - DNA, 2435 bp, Homo sapiens
tcccgggtcgactactattaatttcgcggccgcgtcgatctgagaaggtgacagagttcatgttgtgtgctgggctctggacaggtggtaaagacacttgtgggcataattcacccattcctgtgttgagcacatgcttactgggcacctgctacgtgaccagcattgccgtagaccctgggaagcagcagtgaacagtcaggagctgtggatggtgctggacagaagaaggacagggcctggctcagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53341 - DNA, 1904 bp, Homo sapiens
ggagagagaaagggggacgtggccctgagctgtgggccgggccacccgccactacagagccctcactccagccccagctgcaggtgagccaccctcatgcctctcctcctccccctgctactccacactcctcagatgcccccgtggcctccctcctttttctctcccacactgtatcacccctggcttcctctctgctgtttctccttctctctctgacttcccgcatccttttctcatttgtctatttctcactcccttcctggttctgttctttctcccttcctcttccccatgtctatttcttgctgtctctgtctcttctttgctcatcctaattctcactgttctcccttctgtttttgtcattcctctgccattttatgctctctcttttccacttcgtttctttcagtttctgtctctgcctctcacatgatcacactcctgttttctaactcactgtctgtatttcaccacgactatatctccccgacccctgtgcttttctcactgtttctttttcttccctttggagtctcccttatcctcccctgatccatccctttccccattttctctctcctcatgcatccacccccttcctccccaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtgg

SEQ ID NO: 53342 - DNA, 2965 bp, Homo sapiens
ggagagagaaagggggacgtggccctgagctgtgggccgggccacccgccactacagagccctcactccagccccagctgcaggtgagccaccctcatgcctctcctcctccccctgctactccacactcctcagatgcccccgtggcctccctcctttttctctcccacactgtatcacccctggcttcctctctgctgtttctccttctctctctgacttcccgcatccttttctcatttgtctatttctcactcccttcctggttctgttctttctcccttcctcttccccatgtctatttcttgctgtctctgtctcttctttgctcatcctaattctcactgttctcccttctgtttttgtcattcctctgccattttatgctctctcttttccacttcgtttctttcagtttctgtctctgcctctcacatgatcacactcctgttttctaactcactgtctgtatttcaccacgactatatctccccgacccctgtgcttttctcactgtttctttttcttccctttggagtctcccttatcctcccctgatccatccctttccccattttctctctcctcatgcatccacccccttcctccccaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53343 - DNA, 2094 bp, Homo sapiens
  misc_feature (6)..(6): n is a, c, g, or t
  misc_feature (25)..(25): n is a, c, g, or t
  misc_feature (27)..(28): n is a, c, g, or t
gcagcncctactactactaaattcncnncccgtcgacaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53344 - DNA, 2091 bp, Homo sapiens
  misc_feature (3)..(3): n is a, c, g, or t
  misc_feature (32)..(32): n is a, c, g, or t
gcngccgcctactactactaaattcgcggccngtcggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53345 - DNA, 1910 bp, Homo sapiens
  misc_feature (3)..(3): n is a, c, g, or t
  misc_feature (32)..(32): n is a, c, g, or t
gcngccgcctactactactaaattcgcggccngtcgtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53346 - DNA, 1524 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggaaaaaaaaaaaaaaagtcgacgc

SEQ ID NO: 53347 - DNA, 1832 bp, Homo sapiens
  misc_feature (3)..(3): n is a, c, g, or t
  misc_feature (32)..(32): n is a, c, g, or t
gcngccgcctactactactaaattcgcggccngtcgccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53348 - DNA, 2455 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53349 - DNA, 1400 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtgg

SEQ ID NO: 53350 - DNA, 1363 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtgg

SEQ ID NO: 53351 - DNA, 1277 bp, Homo sapiens
ggagagagaaagggggacgtggccctgagctgtgggccgggccacccgccactacagagccctcactccagccccagctgcaggtgagccaccctcatgcctctcctcctccccctgctactccacactcctcagatgcccccgtggcctccctcctttttctctcccacactgtatcacccctggcttcctctctgctgtttctccttctctctctgacttcccgcatccttttctcatttgtctatttctcactcccttcctggttctgttctttctcccttcctcttccccatgtctatttcttgctgtctctgtctcttctttgctcatcctaattctcactgttctcccttctgtttttgtcattcctctgccattttatgctctctcttttccacttcgtttctttcagtttctgtctctgcctctcacatgatcacactcctgttttctaactcactgtctgtatttcaccacgactatatctccccgacccctgtgcttttctcactgtttctttttcttccctttggagtctcccttatcctcccctgatccatccctttccccattttctctctcctcatgcatccacccccttcctccccaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctca

SEQ ID NO: 53352 - DNA, 2859 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53353 - DNA, 882 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagtaagtaggaccctgggatctggggagggaatggctgtgtcccacaggaataacagcgggatgcttcccccagggtcacttctcaggtgaggcttcagactaaaggagagagggaaggtcctggcccaggtcgcacccggaggcagagctggggctggaccactctccccatggctgcctgggtttctctctgtgtctgatctcgctgtgtctcttggtatctggctctggttgtgtctgtatgactgtgttttggtctctatgtccctctctcttttctgtctccctgtgtctgtgtctcccccgtctctgtctctgggtctctctgtggccatctctgtcaccgtgtgtctcaccctgcatctctttgcctgtctttctctctgggtctctgcctcagcccttcctcatcactactgaacacaccccgtgagggtgggtggggccccgaaaaggaggctttagtcaggtggctgtagggccgcatgccgtctttgggttctcccgggggacaggggcgtcccgtggtgcctgggggaggacaagggggggggggccctcccgggcgggggtggggaggcggcgcaaaaaatcggttttcgtttcgtcgtctttgttcttttcctcggggggg

SEQ ID NO: 53354 - DNA, 241 bp, Homo sapiens
attcgcggccgaatcgacgccgcgtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtgtttccacttttttgaaagggtcttttcata

SEQ ID NO: 53355 - DNA, 3375 bp, Homo sapiens
ggagagagaaagggggacgtggccctgagctgtgggccgggccacccgccactacagagccctcactccagccccagctgcaggtgagccaccctcatgcctctcctcctccccctgctactccacactcctcagatgcccccgtggcctccctcctttttctctcccacactgtatcacccctggcttcctctctgctgtttctccttctctctctgacttcccgcatccttttctcatttgtctatttctcactcccttcctggttctgttctttctcccttcctcttccccatgtctatttcttgctgtctctgtctcttctttgctcatcctaattctcactgttctcccttctgtttttgtcattcctctgccattttatgctctctcttttccacttcgtttctttcagtttctgtctctgcctctcacatgatcacactcctgttttctaactcactgtctgtatttcaccacgactatatctccccgacccctgtgcttttctcactgtttctttttcttccctttggagtctcccttatcctcccctgatccatccctttccccattttctctctcctcatgcatccacccccttcctccccaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagtgtacgcctgggccagatggtgtagctgggagcccagatgcctgggtctgagggaagtggggccaaagaaccaggtggggtccggccacagcccagtttttctctgacccatagtcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53356 - DNA, 2737 bp, Homo sapiens
cagccccaaactcaccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 53357 - DNA, 1501 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtgg

SEQ ID NO: 53358 - DNA, 1536 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggaaaaaaaagaaagggtgaaaggagaaaaagttttg

SEQ ID NO: 53359 - DNA, 3000 bp, Homo sapiens
  misc_feature (3000)..(3000): n is a, c, g, or t
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggcaacacacaaaaaaacaaaaaaaaaaaaaaaaaaaaaaaaacaaaaacaacaaaaacaaaaaaaaaaaaaaaaaaaacaaaaacaagaaaaaaagagcacaacggagacgaagacgaaaacacaacacgagaacgaaagaacaagcgagagacgcgacgacgcggcacgcgcgcgacgacagccgaccgaagaagtagcacaagacagaaaagagcagaacgacgaggaggacgaagaaaggaaggacgagtagaagtaaggaaagaggacagaccaaccaccgcgggcaacaggggagcgcgaagaggagagagacaatgccgagaggcggaaacgggtgtagggggggagacgaagcaggacggaacaacccgcaccccgagcagaggaaagggaaactgctgcaccgacacacaacgcgcacggcgcccgcggcaagggaccacaaaagcggagaggcatgaggcgcgggggaaggcgcggacgaggcgcacgcggccgcaggcgagaggcggcgggaggcagcggggccgcatcgaagccgccaaccaccggcgtggcggaaggaagaacaccgcgccggcacaggggggaggcgacggagcggaggggcgccgcgggcgccccacgcgagaggcagggcaggcagcagagtaagaagaggacggattgatggtgggacgatgggtggaggagagtaagtcagtgaacaagccgaagaaaaggacgttaaggtggcaagcaggagcgtgagaatgagaagtagacggggtaccggagaaagaagggcgagaggcgaggtagcgacagagcaacaaagcagataacaaccacgccagcctgaccccagaacagctcaacacaactcgccatcaaatcaataacacctaacacacacaacggcaaaataaacagctaacagacactaagagccacaccgcgtcaacacacgatcagaaaatcataaacccctgacggcgagagcacccaccaattcaaactctcaaacacacaaccaaataacggtcggacctcctacccacagactcaacagccacagaacaatataacgcaacacacaaaacgagaaaaggaaacgcgaacaacaatcgggaagaaaggacagcagaagacgaccaaaaagacacagaaccgaaacccagcccgcgagcgggaggctgaacgcagagcacacacagaagcaaggaggaccagagaggcacaaaaaagcgacaggaggcagagagagaactgcaagaacagagagcgaggacagggagagggagcaggaacgcaaaaacaagcaagcaagcagggaacacgacagacaggaacggagacggggcgagaggaaaagcaacggagagaaacagccggagcagacggaaaggacgtagcaacagaagacagcgagaacaagcaccagacagaagcggacggaaaacgagcagacaagcagcaaggccaaagaaaccgaactacagaacacaagccgaan

SEQ ID NO: 53360 - DNA, 1095 bp, Homo sapiens
ggagagagaaagggggacgtggccctgagctgtgggccgggccacccgccactacagagccctcactccagccccagctgcaggtgagccaccctcatgcctctcctcctccccctgctactccacactcctcagatgcccccgtggcctccctcctttttctctcccacactgtatcacccctggcttcctctctgctgtttctccttctctctctgacttcccgcatccttttctcatttgtctatttctcactcccttcctggttctgttctttctcccttcctcttccccatgtctatttcttgctgtctctgtctcttctttgctcatcctaattctcactgttctcccttctgtttttgtcattcctctgccattttatgctctctcttttccacttcgtttctttcagtttctgtctctgcctctcacatgatcacactcctgttttctaactcactgtctgtatttcaccacgactatatctccccgacccctgtgcttttctcactgtttctttttcttccctttggagtctcccttatcctcccctgatccatccctttccccattttctctctcctcatgcatccacccccttcctccccaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggatggatcgggggatcctct

SEQ ID NO: 53361 - DNA, 1097 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtgg

SEQ ID NO: 53362 - DNA, 1018 bp, Homo sapiens
cagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggcataattcacccattcctgtgttgagcacatgcttactgggcacctgctacgtgaccagcattgccgtagaccctgggaagcagcagtgaacagtcaggagctgtggatggtgctggacagaagaaggacagggcctggctcagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctca

SEQ ID NO: 53363 - DNA, 581 bp, Homo sapiens
  misc_feature (41)..(41): n is a, c, g, or t
gcggccgcctactactactactactactactaaattcgcgnccgctcgagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53364 - DNA, 1036 bp, Homo sapiens
  misc_feature (909)..(909): n is a, c, g, or t
  misc_feature (920)..(920): n is a, c, g, or t
  misc_feature (926)..(926): n is a, c, g, or t
  misc_feature (952)..(953): n is a, c, g, or t
  misc_feature (983)..(983): n is a, c, g, or t
  misc_feature (995)..(995): n is a, c, g, or t
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggngaaagggggangaagantttccatcccatggctgacttttgannaataacatggtttcccggaaattggggggncccccaaaagcntggccatttggggggcccggcccacaccttaaccttttggc

SEQ ID NO: 53365 - DNA, 806 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctcccccccaagggggttggtcccttttatgggcgggtccaaggggccgaggggtgcccggttgtg

SEQ ID NO: 53366 - DNA, 3596 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53367 - DNA, 2342 bp, Homo sapiens
gttcaggatgctaataaaccctgggggtagcggcaatcatctgcatttttaccacatacacttgaataatccaaaatactgagagttgcttccctatgctcaacatccataggaccaaatttggaaaggtgaactgtagttggcttatatgctggccttaggtgctcttatgacctgtgcatagccatattagctcactggctaagaggctgaaaagattctaccaccttcaggcgtgtggggaacatgaacaggaggctgacaaacaaggagggaagtttctattgtacctggtgagcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53368 - DNA, 3702 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53369 - DNA, 3752 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagaggtgagccagacctaatgtcttttctttgtttctggtctacctgggtttctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53370 - DNA, 1807 bp, Homo sapiens
  misc_feature (44)..(44): n is a, c, g, or t
cggtacctcggctctacttgtctccttcgaggttgaatattccnttagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53371 - DNA, 3587 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgagcttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53372 - DNA, 3718 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgagcttatactgaggtgaggattgtcatctttactgttaaatttgtcctaagctttctataagaagttgacttagacggattgctaaactggtttgttctttttgttcttacctgaactgaaatagtctgtttctttctttaggtgtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53373 - DNA, 3712 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgagcttatactgaggtgaggattgtcatctttactgttaaatttgtcctaagctttctataagaagttgacttagacggattgctaaactggtttgttctttttgttcttacctgaactgaaatagtctgtttctttctttaggtgtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53374 - DNA, 1686 bp, Homo sapiens
aaaaacttaggctaggtacgaggctgggtgtgaattcggcgaggatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53375 - DNA, 1649 bp, Homo sapiens
tcgagtcggccttgttgcctactggaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53376 - DNA, 3533 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgagcttatactgaggtggatccctgcatcctcaacaacaatgtgcagtgagcatgtggaagatttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53377 - DNA, 1741 bp, Homo sapiens
aggttgagcttttggatacaggaacgctaaacatagatcacgtaaggaatattcaactcggaaggtatgttgcagcccaaggatagaaggtcctgaatcttctgaagcatcccgtgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgagcttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53378 - DNA, 3522 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaagcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53379 - DNA, 3618 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaacaacgccaccacaacaccaacacccggctccacaaaaaaaag

SEQ ID NO: 53380 - DNA, 4121 bp, Homo sapiens
  misc_feature (3602)..(3602): n is a, c, g, or t
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaaaaaaaaaaaaaaaaaaaaaaaaanaaaaaaaaaaaaaaaaaaaaaaccacaaaaaaaaaaaaaaaagaaaacaaaaaaggggggacgtaataaagagtcttctcctcgcgggggagccctactttataaaccgccacattttttttacaaaagggggcccctttactaggggcctctatatttatgctgcgtcatgcgcgccgtctgattacacactttgttgatgagagaagacaaatagaaagagagctaatttctgcagagacgcccccaccattatttcgcgtggtggtggaacaacaattatatgtggcagcgcaaccccaccgcccctagaagtaatctattatcaccctgtgggcgggtacatatacaagatcactcaccaggtcgcaggtgtcatctagtctgttgcccaaacctagtcagtcgattattatatcgcgtggcgcagcagacagcatattcttatgccgcagcacagcaacagcagttgaccgacgacaattttatcccaccacgggcgacatgtaaaagaacact

SEQ ID NO: 53381 - DNA, 4070 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaacaaaaaaaaaaaaaaaagaaaacaaaaaaggggggacgtaataaagagtcttctcctcgcgggggagccctactttataaaccgccacattttttttacaaaagggggcccctttactaggggcctctatatttatgctgcgtcatgcgcgccgtctgattacacactttgttgatgagagaagacaaatagaaagagagctaatttctgcagagacgcccccaccattatttcgcgtggtggtggaacaacaattatatgtggcagcgcaaccccaccgcccctagaagtaatctattatcaccctgtgggcgggtacatatacaagatcactcaccaggtcgcaggtgtcatctagtctgttgcccaaacctagtcagtcgattattatatcgcgtggcgcagcagacagcatattcttatgccgcagcacagcaacagcagttgaccgacgacaattttatcccaccacgggcgacatgtaaaagaacact

SEQ ID NO: 53382 - DNA, 3276 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgagcttatactgaggtgaggattgtcatctttactgttaaatttgtcctaagctttctataagaagttgacttagacggattgctaaactggtttgttgctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53383 - DNA, 3505 bp, Homo sapiens
  misc_feature (3462)..(3462): n is a, c, g, or t
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggaaatctaccgtgggcaaatctaccgtgggcanatctaccgtgggcaaatctaccgtgggcaaatctaccgtgggc

SEQ ID NO: 53384 - DNA, 3496 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggcatatctacgtggcaatctacgtggcaattacgtggcaattacgtggcaattacgtggcaattact

SEQ ID NO: 53385 - DNA, 1160 bp, Homo sapiens
acaagtgcacaaaggggaaacactgattttaagaaccgccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53386 - DNA, 1076 bp, Homo sapiens
  misc_feature (1)..(1): n is a, c, g, or t
ncggcacgaggcggcacgagggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53387 - DNA, 3515 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggcctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53388 - DNA, 1035 bp, Homo sapiens
cggtgctccagaggatcccacacttcgatcgcggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53389 - DNA, 1011 bp, Homo sapiens
gagaagagaaaagaaaagaggaagaacagagagaaaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53390 - DNA, 3122 bp, Homo sapiens
  misc_feature (3000)..(3000): n is a, c, g, or t
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctcctcnggagatgtggagaaccaaatgatggtctccagactctttcccagagtcagcacaagccctggggtgacccccaggactctaggagccactccttttccctccagcccaacacagaggtgaaa

SEQ ID NO: 53391 - DNA, 2906 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctccgcgatcgaagtgtgtaatcctcggatcgc

SEQ ID NO: 53392 - DNA, 2824 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaattaaacatctgctaaccaaggtgctgcatttaatgataaccaccttaagacagaacaacgagacatgacgacaacctactgagtaaccaagccacccgtgagctcagctttctgggggtacccgacctcgaaatt

SEQ ID NO: 53393 - DNA, 569 bp, Homo sapiens
aaaaaaaaaaaaaaaaaaaaaaaaaaaaaaaaaaaaaaaaaaaaaaaaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53394 - DNA, 513 bp, Homo sapiens
tgccaaagcgtagtacccaacccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53395 - DNA, 3589 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggtcggagtacctgcgctatgaagacacgctttcttctggaagacagccaacaggtgagaaatgagatggtgatcatgagacctggacacgaacatatgagctaccaagttcggacttttgagctcctcatgggccctctgggacctccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaggaaaggaaagtttcctgcatgttcattcctgatgggcgggtgtctgtctctgctcgaattgacagaaaaggattctgtgaaggtgatgagatttccatccatgctgactttgagaatacatgttcccgaattgtgtccccaaagctgccattgtgcccgccacacttaccttgcaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccatcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53396 - DNA, 2816 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaggaaaggaaagtttcctgcatgttcattcctgatgggcgggtgtctgtctctgctcgaattgacagaaaaggattctgtgaaggtgatgagatttccatccatgctgactttgagaatacatgttcccgaattgtgtccccaaagctgccattgtgcccgccacacttaccttgcaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccatcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53397 - DNA, 2716 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgagcttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttgccatatgcaacatatggcaaggccaagaaggacgcagaaacgtgtgtcatggaggatgccagatgcacacacacactgtgggagaaaggcatttaaatcagacagcaccaaagagaataaagagtattcttattctttatttaaatcagacagccccaaagagaataaagagtatttgtaaggagaagaggcccagagtacccacttttgaaagcagctttagtccctttctgatgtacatgtgatgatttttcaacccaagctgctctttgctttccccattgttcatgaagctcttgggggctcttaccagcctttgtcttccttcttcacaaactctggacacactccatttgcttggcctgccatatgacac

SEQ ID NO: 53398 - DNA, 2243 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgagtcctacattaggaagtcagaggctaagctggacccacactccattgcagagactgttgagtctctgaaaaagtgagtgtccaggaagagagacaaaagaacaagtagtaagctgctc

SEQ ID NO: 53399 - DNA, 1875 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53400 - DNA, 1876 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctactgatctataggagtggtggtaccgagctcgatc

SEQ ID NO: 53401 - DNA, 375 bp, Homo sapiens
aaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagaggtgagccagacctaatgtcttttctttgtttctggtctacctgggtttgtaaaattgtgatggtccagcatttcttgggcaggattcttatgtggccatattttcttttctactcctccctgctatatggatgtcattcc

SEQ ID NO: 53402 - DNA, 814 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53403 - DNA, 3576 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53404 - DNA, 3539 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaagatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53405 - DNA, 3570 bp, Homo sapiens
acgtttccgccttccagcggaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacagggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaa

SEQ ID NO: 53406 - DNA, 281 bp, Homo sapiens
tttttttttgagaaagtttaatgttaaagcattaactggttgagattgcagatagctggggcagtgaggctccttttaagtgctttgaagcacctagggtgaggcactagatcttggaccctgcagtgtctgtagggtgaagctgatccagaacttcattgtgagaacaatcaataggaaagaccatctgacattagagagatctgggatatggtcagttggagctacatggacaagggcaagtgtgtggcaggcagactgagcaacaacagtgggcatag

SEQ ID NO: 53407 - DNA, 244 bp, Homo sapiens
ctgtgaggaagaggtgttacgaaaatgagttacatgtgtgtgttcatatatagagtataacctacatgctgagcaatacattttgaaaacattccattctttttgattcaattgatattttaactttgcaaagttggatgagggttttacttactctctctttttttttaaagctctctctctcttttttctttttaacggagtgaaggtcttattgtcagctgctcagggcatccccaagctt

SEQ ID NO: 53408 - DNA, 393 bp, Homo sapiens
tctgattttccatggcaatttcagatgttttattgttcttaattattaactactcattttgattagtagtttgcctttcatgacagtacaaatttagtattgaaaccttgtttattcagttgatctcatgtatataaatatacatatgtatgttatttgactacggtgccttgtcaaagtatgagagcgttttatgtaaatgaacctgtactgtatatgtaattatgtctgtactgttcagtaattaatgtcatagatctggagttgggacatcctaccttctgtctgctctgttctctactgtaggaggccgatcctggcaaataacatttctcaggctcctttgccagcaggcttttggctcggtttggcaaatgggaagcacacgtggaa

SEQ ID NO: 53409 - DNA, 155 bp, Homo sapiens
accacagaagagacagggcagaaagctggtggaaaaccatctccaacatctgtttctttttctgttaaaatctatccactgtgtgaattgccaaggaaagttaagattcctgttctgaaacgagaagggttctcttttcacatgacacctgcaga

SEQ ID NO: 53410 - DNA, 359 bp, Homo sapiens
tggctgtgtgctattgttttttttttttaagtgaaatatttctctccacccatgtttttaacaaatattgtattgggaaacaagactgtgagagatgaatgcgcttttctcttgctgttctcaggtatttgaaattgttgactcctagtatgttatcatactttagtctttgctaaaccagatcaacgtaaaatgccatttcagtgttttaatctatattttaaattaatgggtaaagtttgtcattctttcatatgtttttcacttataattcttttggggaacgcataccattatcttattttttttctaaactccaatagcagtttaaggttcattgcacttactttagctattaa

SEQ ID NO: 53411 - DNA, 439 bp, Homo sapiens
ttaatttaattatatacctgctatggtttgaatgtgtcccccaaagtttatgtgttggaaacctaattctcaatgtaatggtgttgggagttagggcctaataagaggtgattaaattatgagagttctgccctcatgaatggactaatatcattttccttggagtgggttagttaattatgagaatgggtttgttataaagacaagtttggcccattcttgctcgcttgcttttgcctactcttgaccttctgctttctgccatgggatgacagagaatgtaggcactcaccagatgccgttgctatgcatttgaatttccagtctccagaaccacgaaccatggttcattataaattaacaagtctgtgagagtctgttatgagtataaaatgaactaagtccctaatgtgcaatatgaaaaaatgaatacaagatt

SEQ ID NO: 53412 - DNA, 469 bp, Homo sapiens
gggccagtggaggctcccaagaggctgtccacggggaccatgttaggtctcttcaggctccaagggcaagtctaaggggggaagacccccatgatggtgtgcccttttgttctgaagcagctgcctccctctgctttggtgccaggcactgaaaacatttttcttgatttaggggccccacttatacttaacatagacaagagataccaggatgtgctcacatcatagtgagcatacacagcaagaacacgtagtgtgtccatcagtgtcctcatcacattgctctccttgtgtttgttgcaaggctgctggtctcccttccagactgagctcctcatgggccagggctgtgcttgagctgtccttgaattcctagtgttagaaaagggcacagctgtgggagccccggatgaatgtgctggaccaaatggcagagctagagtccaaaccctgctctcactctgtccac

SEQ ID NO: 53413 - DNA, 447 bp, Homo sapiens
attaaaagattataggtatttgtgctatatcttgaatttatccacagacaaagcacatttaaatttgatcttatagccacttgaagacatatgatggaaattctgactagaaaatgctgccaaagtcattaaattttatttagaaaatacataaaatacataaggtatactagatataagatgtaccagctacctgaaacaacagatgatgcctcacatatagagcaaaatgtggtctttggtggaaaaggaaatcaattttggatttgtgctatccacaattctttgatatgaactattgcttgttattaataatgtaaacaaaataggtaggaggtcctgaaagggagtcctccttaaaaggtttctggcttagtttcctttcttttgaggatttttaacatataagccaaacgaaatccaaggattaaactgaaaaaaaaagta

SEQ ID NO: 53414 - DNA, 726 bp, Homo sapiens
ctctggcaggggtgggggcggtcagaagcattaatatgcttcagcttatcaaatatatataaactcttgagccacttgagtagcacactgccatgtgttagtttcttaggaaaagatataatcaattttagaaatgatatcttaatttactttagctaggacaaaatgatttgattataccccctcacctctttgactattttgttactctgctggaagtctggcaagtatgattacatgaggctaagcagatgatttcccatccattgctgaaacccagggctgccccattgtacaacctcagggaataccattttcacgtgactttcctggagcacagcagtgtgactggtgctccctggagctgggcagcacactggcctggctatcccagtattactccccgtactttgctgcatctgctcaatgctgcatttcattccctatcttggttaatggtcccatcaaaaccagaaacctgggagccatccttgattccctccttttcctcactttcctttccaagtctggttagttttctctgccgaaagtggacaacttaccttctctttttcctcatatctaccaccctgatcccttcttgcccactgaaacaattgcaccagcctcctaattgatctcttagctatcgtcttccacatcactgctagagggactgatcagaagggcaattctgaccatgtcagtcgtcattaaaaaaaaaaa

SEQ ID NO: 53415 - DNA, 509 bp, Homo sapiens
gccacttttggagccttgaatccaaggttgggactacggctgtggaatattatgtgtcctaggcacttgctaagtgcgttctgcaggaaaacagcttcaccgttgcccaagaactcatcaggttctcaggctccagcctgatctactaaatcagcatctgcagtttaacaagatccccaggtgattgatagtcacctgaattttggagaagcactgttgtggtatcacagctagaaactcatgatggcgtaagaggaataggagacagtgagttgaaacaggaactttgggccaagatttgtaatagcaaatcttgtgaataccatttcctgtccttcacagtacctgcaatgacagtacattttttctggcttttgccaccttgccaccttctgccttggatctttagaacaccacaggatccaatgctagtcttctaggatgggggtccataaataaaatccttggtctttcctaagagatggatactggtgtcaggcagatgtaga

SEQ ID NO: 53416 - DNA, 5330 bp, Homo sapiens
ataaaaggctcacacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccctcccttttctgactgacactaagtctagcacacagcacttgggccagcaaatcctggaagcagacaaaaataagagcctgaagcaatgcttacaatagatgtctcacacagaacaatacaaatatgtaaaaactctttcaccacatattcttgccaattaattggatcatataagtaaaatcattacaaatataagtatttacaggattttaaagttagaatatatttgaatgcatgggtagaaaatatcatattttaaaactatgtatatttaaatttagtaattttctaatctctagaaatctctgctgttcaaaaggtggcagcactgaaagttgttttcctgttagatggcaagagcacaatgcccaaaatagaagatgcagttaagaataaggggccctgaatgtcatgaaggcttgaggtcagcctacagataacaggattattacaaggatgaatttccacttcaaaagtctttcattggcagatcttggtagcactttatatgttcaccaatgggaggtcaatatttatctaatttaaaaggtatgctaaccactgtggttttaatttcaaaatatttgtcattcaagtccctttacataaatagtatttggtaatacatttatagatgagagttatatgaaaaggctaggtcaacaaaaacaatagattcatttaattttcctgtggttgacctatacgaccaggatgtagaaaactagaaagaactgcccttcctcagatatactcttgggagagagcatgaatggtattctgaactatcacctgattcaaggactttgctagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacacactaaaactaatcttcattttaaaagggtaaaacatgactatacagaaatttaaatagaaatagtgtatatacatataaaatacaagctatgttaggaccaaatgctctttgtctatggagttatacttccatcaaattacatagcaatgctgaattaggcaaaaccaacatttagtggtaaatccattcctggtagtataagtcacctaaaaaagacttctagaaatatgtactttaattatttgtttttctcctatttttaaatttattatgcaaattttagaaaataaaatttgctctagttacacacctttagaattctagaatattaaaactgtaaggggcctccatccctcttactcatttgtagtctaggaaattgagattttgatacacctaaggtcacgcagctgggtagatatacagctgtcacaagagtctagatcagttagcacatgctttctactcttcgattattagtattattagctaatggtctttggcatgtttttgttttttatttctgttgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattagaaaagaaaaaattaaaacatgaaatgataacaaaagtaaacaaaagatactttcaaagcagtgaacaaaacattttgacataagccataatataaattataatataaaaaataaaaaccatagtataaattgtcagcctttgagttggctacaaattcaatttaatgacagaagagaagggatgctggaggtaaattcttagggtttctatctcatagagtttgctcttctggttctctagactgccaaagaacataaagatgtgcgaggggacctagctgtagtaaaagcaatcctataacaagaaaaactctaaaacagtgccccttacgattttctactgaaatttctctaatagtagaggtgtaaaataagaagttagagaataatgcaaagggggcccaccacagacggaacatttcttttctcttaagactcatgtgatttttgcatcttactccataatatatttcgtggttgcgttaatatgacaatgtctgcaattaaacaccagtaagcaaaattgatacatcagaatgacttgcagggcttatcatgcagtttggtttacatccctactccactgccatttacttgagcgtgaatgagacacaaaagattatttgcctcccataatccaactttacacataaataacacaaggctaaagaaaaccagaactcaaattcaccacgcataggagtgataacaaaaatatttaacagtcagtatgggtgattactggccaatcagaatacatcactgatacatcgaaatggatgcaggccactatgactaacttgtgggtatcatttctatgatcaccctaaaacagagttgggaaaatatctattaactggtctctctggtttgaattctcaatatgtatcttaatatgaaatagctcattaaaacttcatgtgtaactatttcagcattgttgtcagctactctttattccacttctgtacagtatttattcaaccaagctgctgctttcaatgaaggtcacttgttccttcagggacacatatactcccacctatcctttaattttgaatggtttgtcaggaaaatttactttctcttgagttgaaaaacttgacaggaagcaagaaataatacagtcctagcctctttccaataacatctgatttctccattctcaaactacacttctcaaggaaccagatatttactctcatctgggaagatgcctcttatgttttccttttacttcctggttatcatgtggttgcattttccaagttcttatcattgaatttatgagagcctatcaaaatttattttctttcatttatattctaataattgaaatgtgagatgaaaataacatttcacttatgaaaaacccttctcttgatgaatccttccatgtgttagttatctattgctgtgtaacaaattaaaacttaatggcttgaaaca

SEQ ID NO: 53417 - DNA, 4860 bp, Homo sapiens
ccgcgcacagtggtggccaccgcgactggtgctgaagtgtcggcgcgtgccgggcgctccgctgggacccgggttgctcgccctgagtctcagctttctcatctgtacggttgggacaagtacagtaaccctcgcccgtcaagacgggccaggctgtggcgagggtccacgccttagagcaggcacctatcttgtgcagggccctgagacggggtctgactcagttcctgcggggaacttcaccagtgacccagtcagtgcccttcagttaaagaccaccaggagcacacttatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccctcccttttctgactgacactaagtctagcacacagcacttgggccagcaaatcctggaagcagacaaaaataagagcctgaagcaatgcttacaatagatgtctcacacagaacaatacaaatatgtaaaaactctttcaccacatattcttgccaattaattggatcatataagtaaaatcattacaaatataagtatttacaggattttaaagttagaatatatttgaatgcatgggtagaaaatatcatattttaaaactatgtatatttaaatttagtaattttctaatctctagaaatctctgctgttcaaaaggtggcagcactgaaagttgttttcctgttagatggcaagagcacaatgcccaaaatagaagatgcagttaagaataaggggccctgaatgtcatgaaggcttgaggtcagcctacagataacaggattattacaaggatgaatttccacttcaaaagtctttcattggcagatcttggtagcactttatatgttcaccaatgggaggtcaatatttatctaatttaaaaggtatgctaaccactgtggttttaatttcaaaatatttgtcattcaagtccctttacataaatagtatttggtaatacatttatagatgagagttatatgaaaaggctaggtcaacaaaaacaatagattcatttaattttcctgtggttgacctatacgaccaggatgtagaaaactagaaagaactgcccttcctcagatatactcttgggagagagcatgaatggtattctgaactatcacctgattcaaggactttgctagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacacactaaaactaatcttcattttaaaagggtaaaacatgactatacagaaatttaaatagaaatagtgtatatacatataaaatacaagctatgttaggaccaaatgctctttgtctatggagttatacttccatcaaattacatagcaatgctgaattaggcaaaaccaacatttagtggtaaatccattcctggtagtataagtcacctaaaaaagacttctagaaatatgtactttaattatttgtttttctcctatttttaaatttattatgcaaattttagaaaataaaatttgctctagttacacacctttagaattctagaatattaaaactgtaaggggcctccatccctcttactcatttgtagtctaggaaattgagattttgatacacctaaggtcacgcagctgggtagatatacagctgtcacaagagtctagatcagttagcacatgctttctactcttcgattattagtattattagctaatggtctttggcatgtttttgttttttatttctgttgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattagaaaagaaaaaattaaaacatgaaatgataacaaaagtaaacaaaagatactttcaaagcagtgaacaaaacattttgacataagccataatataaattataatataaaaaataaaaaccatagtataaattgtcagcctttgagttggctacaaattcaatttaatgacagaagagaagggatgctggaggtaaattcttagggtttctatctcatagagtttgctcttctggttctctagactgccaaagaacataaagatgtgcgaggggacctagctgtagtaaaagcaatcctataacaagaaaaactctaaaacagtgccccttacgattttctactgaaatttctctaatagtagaggtgtaaaataagaagttagagaataatgcaaagggggcccaccacagacggaacatttcttttctcttaagactcatgtgatttttgcatcttactccataatatatttcgtggttgcgttaatatgacaatgtctgcaattaaacaccagtaagcaaaattgatacatcagaatgacttgcagggcttatcatgcagtttggtttacatccctactccactgccatttacttgagcgtgaatgagacacaaaagattatttgcctcccataatccaactttacacataaataacacaaggctaaagaaaaccagaactcaaattcaccacgcataggagtgataacaaaaatatttaacagtcagtatgggtgattactggccaatcagaatacatcactgatacatcgaaatggatgcaggccactatgactaacttgtgggtatcatttctatgatcaccctaaaacagagttgggaaaatatctattaactggtctctctggtttgaattctcaatatgtatcttaatatgaaatagctcattaaaacttcatgtgtaactatttcagcattgttgtcagctactctttattccacttctgtacagtatttattcaaccaagctgctgctttcaatgaaggtcacttgttccttcagggacacatatactcccacctatcctttaattttgaatggtttgtcaggaaaatttactttctcttgagttgaaaaacttgacaggaagcaagaaataatacagtcctagcctctttccaataacatctgatttctccattctcaaactacacttctcaaggaaccagatatttactctcatctgggaagatgcctcttatgttttccttttacttcctggttatcatgtggttgcattttccaagttcttatcattgaatttatgagagcctatcaaaatttattttctttcatttatattctaataattgaaatgtgagatgaaaataacatttcacttatgaaaaacccttctcttgatgaatccttccatgtgttagttatctattgctgtgtaacaaattaaaacttaatggcttgaaaca

SEQ ID NO: 53418 - DNA, 1690 bp, Homo sapiens
  misc_feature (827)..(827): n is a, c, g, or t
ataaaaggctcacacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacagtaagtaattttaagtactgctcatgaaccttagcaatctgttaatggatcaattttcaggtganatgttttctcatcttccttttgcttcttggaaaaaaaattaaataaaatgtcacctaatttctctaaattgaactatgttgaactatgcccctaaaaatatctcttttaacagggcaaatctacttacattatagttggacctgataatccaagccaatttgaaaatatatactccttgtcctgaaaatgctcataagttaagcaaaatgtaaataatattattcacaccaaaatgtgacttaatattgtctaagcaaaactcattaagatatctaatttagaacttcataaattatcactaaaagctatttatcactagtttaaagagtagggaaattatttttattaatttgattttctttgaaataatattttcatgatgtaaattaaaatacttaatctgtgctaagatatgcattcctttgcaattgtgtataatgataaaatagaagggaatctgtggtatccttattcatttgagtcataatgagcttgtattaagttgatgacttatcaacttaggcagaaaaacagatctctcctaacgttttccttaactaaatcttttatgtcataaaagttctgtgctatcttaagaaaaatgtaaaggtgaggggaaaaaagtgggctggaagagatggtaattccatgtttttcaatttaaagccttacatttttcccaagaatcagttattcttcttatgttaaaatatcagggttgtgttttgcatttaatggttatgatgaataaccaacttcaatagtattaaatgtaatggaataagatacacacctcaacatgtacattaaggatttaaaatacttagtaaaaataaattttgtttacattactagcactcag

SEQ ID NO: 53419 - DNA, 767 bp, Homo sapiens
  misc_feature (408)..(408): n is a, c, g, or t
taactagtacacagaagccctgctcttgagggtgctgctgtactttagcctcttcatcaagcagatgccttacctttgatctttctctggctccttacatctgttctcagttggtaaagaacccggaggggggagaagcagggaggggtgttattagcactcccggatcaccctcactggcctgttggtcagaagactcttgataaattaacacaaggaaccaaatgggggcaagggcactgctggctggggaaagaggccatttgctgctttcctttctccctatccccagaaggagagtcttccttctgtgctccttaaggatcccctaagcagtgtctactccgttgctcgggctaggtgttttacccctctccttcgttatctgcagacctttccccaaacttnctgagtctgctcaaagctagagttttcgtgaacagctctttcaagggtgccacttggagccttgggtggtacgaaatggatgtcttcacggtgagccttgtgtctgctccaagtgcgaaccctccatgcactgcagagaacaccagaaggagaggagcactacctgagctttctcttccgggtctaaaggtggaaacttctttgcagcacccagcatttcactgtactgattcctttttttggatcaccacctcctgcgtttagcagccatatgctgggctcactcagctatacactgcttgttcataactactgtgggttcacagggctgaaacactgcctcatttttcttaatcaga

SEQ ID NO: 53420 - DNA, 174 bp, Homo sapiens
ccaaaatgtaagaaatttgattccttaatctctctttctaaaagttactttaagcaaaattccttcaaatattttagcagtgtctatactgtcacgtagaaatgacaagaataaaaattctgcttcttgtttagaaaatggaaagttgtgattatgtgtttctaaaaaatataa

SEQ ID NO: 53421 - DNA, 746 bp, Homo sapiens
ttgattcaggctgagagctcaggtgttccctcagaatctctgaatccttcaggaaacgagaaatgtttgctcttcctcctaagaggaagtgactcaccaaatttgtactaaccttagttaggctgggtagtacttcttcccctcaattgtggagagtcattctttccgtgtttatatcctttacttagtaaaatgtgggcatggctcttgtggccgagagagactgatggcctcctctgaggttaacaaaaaattttaaacacacgcccactgtctccatttgtaatattgtcattttgcctctgtaattttaagtggttcaaacttaatgtgtttcctaaacaatttggaaagtttaaaaacattttgtccctttatttctctgttaatgggcttttgaaaactatggctatcctttgcttttaacttaaaaacactttcttttgaaaacttttatggctgggtgcagtggctcaggcctgtaattccagcactttgggaggctgaggtgggaggatcacttgaggcaaggagtttgagatcagcctgggcaacatagtaagaccctgtctgatccagcaccagccccccgcccccagcccccccaaaattagccaggtgtggtggtgcccacctgtagtcccagctactcgtgaggctgaggcaggtgggtcccctgagcccaggaagttaaggctgcagtgagttgtgatcatgcttgggtgaaagaacaagaccccatctca

SEQ ID NO: 53422 - DNA, 137 bp, Homo sapiens
  misc_feature (5)..(6): n is a, c, g, or t
  misc_feature (8)..(8): n is a, c, g, or t
  misc_feature (120)..(121): n is a, c, g, or t
  misc_feature (125)..(126): n is a, c, g, or t
  misc_feature (128)..(128): n is a, c, g, or t
  misc_feature (130)..(130): n is a, c, g, or t
  misc_feature (136)..(136): n is a, c, g, or t
ttcannanagattctgctgtctacatcaatacacctgaatagttggacagaaaattgaaatcttttaactaattctaactatgaagcacagtgaaatagaaagttaggctgtaagaagtnnggcnntncngtgtgnc

SEQ ID NO: 53423 - DNA, 456 bp, Homo sapiens
attgagctgtgtcgacatttgctatatagactgtagggcctaacgagtgcttcttgagaccctttcctacttacagtggctctccttgtcatcttgctgcctcttttagtttgttcttggctcagaggctagatgtccatggtataacttagccatcaaaacagggatggggctgggcacagtgactcatgcttatcatatcaggagtttgggaggccaatgtgggaggattgagcccaagagtttgagaccaccctgggcaacatggcagaatcccttctctacacacacacaaacacagccagacatggtagcgcctgcctgtacacacacatacagagccagatgtggtgctgcgtgcctgtagtcccagctactcaggaggctgaggtaagaggatcacttgagttgggcaggttgaggctgtagggagctggcatcatgccaatgtactgc

SEQ ID NO: 53424 - DNA, 402 bp, Homo sapiens
  misc_feature (28)..(28): n is a, c, g, or t
gggggtgatttggatcatggggagttancttctccatggtttaacacccattccccattggggctgttctcacaacagagttctcgtgagatctgcttgtttttatttatttatttgagacagagttttgctcttggttgcccaggctttctttacagcccttctgagaaggaacaacctattgagcagcaggatgggagcattgtgcattggactatgcgtgatactatacacatcagctttgcacaattttttttaaatcaagtgtttgagtctctacaaatgaaaaaaacatttagcaaatactgagttcataaaatatgctctagggaaaaaatttctagaagattatatttttaaagccatgtaagctgagtgtaaatggacagaactaggaatact

SEQ ID NO: 53425 - DNA, 2728 bp, Homo sapiens
  misc_feature (1087)..(1087): n is a, c, g, or t
  misc_feature (1539)..(1539): n is a, c, g, or t
  misc_feature (1811)..(1811): n is a, c, g, or t
actgaaataaataaagagaagcatggtttttgaatgttctccagctttagatgcattgaagttttcaagatcagtcaataagcatttttctgcccaattacctgtgagaagatgtatctattgggaataaagaatggggggcggggggtattggaaaggctgatcaataaggctgggcttcatgtcaaacatgtcaatgtatgcttaggccagtttcaaatgtttggtggcattttgttcacaaaaggatagagtgtgtgcatcatatttgttttttttgttttttcacaaaattgagttaaatccagtgcttttgttattggctattcttcatgtagctttctttagggtggttgtttacaaagacttcggcatggtttcacagagactcattccagtggaatccagttagatggtcctaatgctttcgttccagctatgacatgtgttttgattcacagtatgcttggatggactgtgtggatgcttcattcctatggaagacataattcagaacagaaaacttgtaacagcagcatcttgcctgcaaaattatttaagaaaaaaaaaaaaagactttctggttaataccaaaatctttaactgtcctttagataggtactgtttcaagtaattaacccactgtgattctcaacaatgggtccataatagccttacctgaacattaactcctcctatttgcccccattactcccagagattccggtatttttttagtggggctttggtggtggtgtgcgtgtatgtatgtatgtgtatatgttatgtatacacatgcacatatgtgccttgggtgtatgtaactatgtatgtatatacacacatatttttaaacataaatttttataatattcattttaaacaaaagtatacagatatataatcttaagcaccacaggtgagtttgaagtccagccattgttgggaaccatggaatcaaacacaattttttaaaagcactttgctttcatgacaaataatacacttaaggataggaagagaaggagatgctcacagatacaaagacgttaaaaaaaaaatgcccatgttcatgaaggggcttgcntacaaccaattgctctcttatttcacgggctcttttgattttacataaagttcagtgctataaaactctgtaaaatttcattatgtttttaaagtcagaggcagggaaaaagtcacctccaggtgtttagaaaactaaaaaagactgccatttcactgggctaagtttgaagccccgcagatgcaagtgccttgtattcatgagtccacaaataaggaggtgttaatgatcaaggtagtggttgagtggatcctggtaaatacagcttcaattggagatggactcaagcagttcagcatatacagcagacacacaagctgatgataaccacttactatgtgctaggtactgttctgatgctttgcttacatcacctcatgacatctcgacaacaaggtaggtattattatccctgctttatcaatgagaatttcagtcacagacccttgacnacatttgctcagctagtaggcagggactggaactcaaatccgtgtgacttcaaagccacgcagcaaccaccacaccagtcatatgctctgccctgtggattgggccatattgaaacaataaagaccatcgagctgatggatttcgaaccacttcagagaaatatgtaaaaggcttacatgcaaaaatatgttcagaagacaagccaaaaggccaagtattcttgtaaatgtggcagtgatgactgaagactttattaaaaatatattaagcntgtagatagagagtgaactgctcataaatctaggtggttttgtttacttctatttttctgtatgtttgagatatttcattgctgattatttttgggcaacgggacatggaagaaagttgataagctcttctgaattatgacttattcaggtagttttgcataaaccagagggcagataattgctgatatgacctcaacaaagagataaggtggagaaaggaatgtttgctaattatctacaaaggaaagagaaaggtgagaaataataagttacctgattctctgtgttctgtgcttacttgttcctccaaagcattctccccagcatgtctcttccagcttaataactgaaaacacttagtcaacaacaatacactctagtggaaaagagatcctgttagttttctagacgatgcctgttgtgggtatattgtttccaaaattatattagtgctcatgagctggaatcgctgcactttacacactcaaaattatgagaccatttgtccccggtggtagctcagtttttggagtgaacctcaaaagcaatccttggctaacagaagattcttccagattctagcaatgtttgttcaaagtggggcatagctggccaggtgtagtggctcacacctgtaatctcagcactttgggaggctgaagcaggcagatcacctgaggttaagagttcaagaccagcctggccaacatggtgaaaccctgtctctagtaaaaatacaaaaaattagctaggcgtggtggcacacgcctgtaatcacagctacttgggaggctgaggcatgagaattgcttgaacccaggaggcggaggttgcagtgggccgagattgcaccacttcactccagcctgggtgacagagtgagactccatctcaaaacaaacaaaaaacaaaaagc

SEQ ID NO: 53426 - DNA, 206 bp, Homo sapiens
ggaggtaacaagagaaacccaaaataggttgaagggaaaatcaaaggcagcaaagaagtatatccagcttcccatccagaactctacaacatgatagacacagagtggccagtacagccatagcacagatgtggcagtcaagcgtactatgaaaggtggaaaagtggggggatgagggaagaggtcctaaactaagttattagctc

SEQ ID NO: 53427 - DNA, 195 bp, Homo sapiens
ctttgcacctctcagcctaagaacacaagtgtctgtagcatatataatagctatgccttaccagcacaggaaagacagtttgtcatagcgcagtagaagggagttcatcatgcctgaattccagtcttggcactgccacatggctaatgtctcagcctcagtttttcatctgtaaaataagcttttgataaaatt

SEQ ID NO: 53428 - DNA, 424 bp, Homo sapiens
aatccaaatcaaattcttgctcactatcctgaagatcaaacacttgagccctcccacagatctggaaagaaaaggcctcccaccaaggaagcatgaccatcctgcctaaaatttgaattaaaaatccagttggcccagctcctcagtgggtggattctggaaagggatggttacccagggtgaacacagcatcctctgggaagggcttgttggaatcagccaggtttagcctgggctataggaggaagcctggcctcttatgtgttactaatccgtgatccagagagactcatttaaaaaggcctcagccaggcgcagtgatgcacgcctgtaatcttagctacttgggaggctgaggtgggaagatcgcttgagcccaggagtctgaaaccagcctgggtaacatagcgagaccttatcttca

SEQ ID NO: 53429 - DNA, 479 bp, Homo sapiens
gtccatttcccttctctgaaggatggcactcttgcattgcctgttgcagcctcaacataattgtttcctatgttttttccaattttctattgtttacagaagaacattaattctggaccatttaactcccaaatggccagagctgaagttacttgttctatttttaatttcgatatattttttttgagacagggttttgctctgtcacctaggctggactgcagtggcgtgatcatagctcactgcagcctcaaactcctgggctcaagcaatcctgcctcagcatcctgagtaaacctgttttattttgaatatgttcaagtgggagatgttgaggtagttatgctgctagctatatacgcattcaacaatattcagcttgcatttattgactactcgctgtgtgccaggttttcggttaggtaccagggtcatcgagatgaaggacagtagtcctttcccatggggagataatagtc

SEQ ID NO: 53430 - DNA, 581 bp, Homo sapiens
tttatttctaaaagagttataatttgcccatgatcacagagctaagtaaatgatagagctatgatcggaacttcaactttctgattccatgtctgttagcactgtggaaggctgtctttggcattttaatatacttatcaagtgtttcatatacattggttaatttgtccaactgccacagagtgggatgggtggctctttttcctaaactgtagccatcttttccccaaagtgtagccttcatgaattttgccctatttatatatcacctatgctattaagttacctaccatttaaaatttttaattaaatgtgttatttcttaccctcattcctaaataatagccatggaaaaaccattgatgtgctaattttttttcttgaatccacactaaaataactacataaccattaaaatgaaaaatgcattagccaggtgtggtggtgcgtgcctgtagcctcagctactcgggtggcagaggagaagaatcgcttgaacctggaaggcggaggttgcagtgagccgagatttgcaccgctgtactccagcctgggcaacagagggagacttcatctcaaaa

SEQ ID NO: 53431 - DNA, 284 bp, Homo sapiens
ctctgtgaacactgaagatgctctaaaattatctgttgcatgaataaatgaatgaatgaataagtgagtgagtaagatgcttctatacctagagggatcttaaaaattactactacgactgagggacaggttgagctaatccagaaagttactatgagtactttgtccatcatttacgttctaaaattcatcatctgaaaatacttcacaacatgataaaccttcccaccccatcacaaacaagtctccagaatcaggttcagcagtgagtggccgtgtgtaca

SEQ ID NO: 53432 - DNA, 385 bp, Homo sapiens
cttcatttccaatgtggatttctcctgatctcatgaacaatacatccaactgctaaatcagtggctatctccagttgcatgtcccaccataccacagatttcacctatcattctgtcccctgcttctgcttccatctaagccttgctttcattttttcctgcctttggtatcttgtgagatctcaaaccacttaacttggttaaagttttatttttatgtttctttcacactcaatataaattggtacctaaaatctcccctttaactcatggtagatattaaagacatgtgcttgctaatcagtgaatgaacataaatgacaggatgctgctaatatgatgggcttttttaataacctctgattaatatcagaacaaggttcaa

SEQ ID NO: 53433 - DNA, 428 bp, Homo sapiens
aacaaatttgaaacctaaatcttctttataaccttttaacctgtcatttcagagcaagcagtaattttaaggtggttgaaaatatgaatgtgaacacaaagatggggctcacagtgggagactggtccaccatgatagcatatgagaagcccatgtgaccaccatgagcatgtgcaccgaccacaggccataagagatacgactcagccataggctacaaacatttggtttgcttggcatgcacattcctctcttgtaaaatgatgcatgagactctcagagctaaattcattaaaccatctccttttcctctgaatccctgtctattctggccctaggcattttcagccatgctgggagttttgtgttagtctaggctgtgtatttcagcttctggcgagtttgtgagcatgacttagcatccttgt

SEQ ID NO: 53434 - DNA, 457 bp, Homo sapiens
tgttcaggctggtctcgaactcctgacctcgtgatctgcccgccttggcctcccagagtgctgggattacaggcatgagccaccgcgcccggccgatttcaggtaattcttgttcatctcagtgagaactcagaatgggatgttagattgtaagtcttgtgcttggtgaatgggtttgggcaacagctcatggtttgttaatataaaatgtaaaaggcactagttgtgccaggcagatcatcatgtgcttttccatgaaactaagcacattctgttttgttttgaggttaatagactagttgcagttctgaaacataatattttctgaataatgtgattgtgttgctatgcacttatctttgaaaagcccttgtgcaaactgaattctaggatctttgtatataggactgaggccaaagctgaaaagggcaacttttttttttgcagaaaaaccttg

SEQ ID NO: 53435 - DNA, 342 bp, Homo sapiens
ggacagtataaaatacagtttcgctttactgagcaagctatatagggaagccttcataaactgggattacaggcgtgagtcaccgcccacggccgctttatttattttttagaaatgtcttgatggtcgttctaggccatacacagatactgactggggtcttttgaatggtgtagtaaccggtagaaggggctctgctaaaggatgcgtttccactgttagccaggcagtggcgaatgtgtctgggcttatgtgtgaacgtttctgaagcggagagtgctagtgcgagccttgggggtgcgcacatggagagttgagatactccagcggtgccgcctgaaa

SEQ ID NO: 53436 - DNA, 4357 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53437 - DNA, 440 bp, Homo sapiens
tctctctctctctctctctctctctctcctcgtgccgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53438 - DNA, 637 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcaggtaaaaataaagtcaaatttctttccatttatgaagggagaaaagcacatgaaagc

SEQ ID NO: 53439 - DNA, 625 bp, Homo sapiens
ttcagattttttaatttgtataaggaaaatagatgtgctgagttttttaatatagtagttacattcatgtttctctaaacctgaaatgttctaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggtatcttgtattttccagttatactggaattaatgaattgtgtgcatgcatacactttgtatgtttaaaaaaaaaagtcctctgccaggcgtggtggctgacacctctaattccaacactttgggaggatgaggtgggtgaaggcggatcacttgaggtcaggagttcgagaccagcctggccaacatggtggaaccccgtctctactaaaaatacaaaaattagccaggagtggtggcatgcacctgtaatcccagctactcggggagctgaggcaggagaatcacttgaacctgggagggcaaggttgtagtgagccgagattgcaccctgtacttcagtctaggcaacagagtgagacttcatctcaaaagaaaaaaaaaaatcctctgctt

SEQ ID NO: 53440 - DNA, 639 bp, Homo sapiens
  misc_feature (556)..(556): n is a, c, g, or t
  misc_feature (571)..(571): n is a, c, g, or t
  misc_feature (596)..(596): n is a, c, g, or t
  misc_feature (630)..(630): n is a, c, g, or t
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaaggaaattaaagggaccaatttaaaaaagggaatcttttatttaccaccagggccccncccctttggtttggngattaccaaatggggccccgatttnaaaaatttaatttaattggtattggaattcaagnaaaacccca

SEQ ID NO: 53441 - DNA, 261 bp, Homo sapiens
ttttgtcccccagccaagctctaaagcacatgtagccgctgagacctgctgtatccggtggatcaggagtttgagaccagcctagccaacatggtgaaaccctttctttacgaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53442 - DNA, 4320 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaagggaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53443 - DNA, 3715 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatgaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53444 - DNA, 2340 bp, Homo sapiens
cctcaccagactgcccctggcagaagcaggaagcacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53445 - DNA, 4427 bp, Homo sapiens
  misc_feature (4409)..(4409): n is a, c, g, or t
  misc_feature (4414)..(4414): n is a, c, g, or t
  misc_feature (4421)..(4421): n is a, c, g, or t
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaacgcctttaaaaaaaaaaaaaaaaaaaaaaaaaaaaaaaaaaaaaagaaaaaanaaaanaaaaaanaaaaag

SEQ ID NO: 53446 - DNA, 4497 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaacaaaaaaaaaaaacaggggggcgtctaaatttccacagggccacaaatcagacgagcagaatttttgcacaagggccacagagaacacataaaaaaagcacgaccgcaaaaagcaatgggacaagccatgccttggacgac

SEQ ID NO: 53447 - DNA, 4148 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53448 - DNA, 1539 bp, Homo sapiens
gaaaaaggcccaaggggcctttgggggttaaccccgggggggtcggaattccgggattgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53449 - DNA, 3317 bp, Homo sapiens
  misc_feature (3317)..(3317): n is a, c, g, or t
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacactccaaaggagaagaaaggtcttgtgtttgttgaaaaacaaaaatggggccccaaacccaaaaaacgccgtgcgccccaaaagcgagaaaataaaaagggcttccaaaccgaaaacgttgtgtctctctatgtgaggggaaataaaaaatccaaaacccatatttttttcaagggaagactttttcgggtggaggtctttgacgggggccgaaccaacgggtggcgctcttn

SEQ ID NO: 53450 - DNA, 1011 bp, Homo sapiens
taacgacaggctggtacggccccgggagtaagggaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53451 - DNA, 905 bp, Homo sapiens
gcactcatgttctacatatgagaatcctctccgagtctagcctcgctctcgtgcatgactctggtgctggccggcgtaatccaatctcgagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 53452 - DNA, 3246 bp, Homo sapiens
  misc_feature (2930)..(2931): n is a, c, g, or t
  misc_feature (2933)..(2933): n is a, c, g, or t
  misc_feature (2943)..(2943): n is a, c, g, or t
  misc_feature (2981)..(2981): n is a, c, g, or t
  misc_feature (2983)..(2983): n is a, c, g, or t
  misc_feature (3002)..(3002): n is a, c, g, or t
  misc_feature (3009)..(3009): n is a, c, g, or t
  misc_feature (3018)..(3018): n is a, c, g, or t
  misc_feature (3025)..(3025): n is a, c, g, or t
  misc_feature (3029)..(3030): n is a, c, g, or t
  misc_feature (3032)..(3032): n is a, c, g, or t
  misc_feature (3037)..(3037): n is a, c, g, or t
  misc_feature (3039)..(3039): n is a, c, g, or t
  misc_feature (3048)..(3048): n is a, c, g, or t
  misc_feature (3057)..(3057): n is a, c, g, or t
  misc_feature (3060)..(3060): n is a, c, g, or t
  misc_feature (3071)..(3071): n is a, c, g, or t
  misc_feature (3073)..(3073): n is a, c, g, or t
  misc_feature (3077)..(3078): n is a, c, g, or t
  misc_feature (3084)..(3084): n is a, c, g, or t
  misc_feature (3089)..(3089): n is a, c, g, or t
  misc_feature (3095)..(3095): n is a, c, g, or t
  misc_feature (3099)..(3099): n is a, c, g, or t
  misc_feature (3103)..(3103): n is a, c, g, or t
  misc_feature (3107)..(3107): n is a, c, g, or t
  misc_feature (3112)..(3112): n is a, c, g, or t
  misc_feature (3114)..(3115): n is a, c, g, or t
  misc_feature (3119)..(3119): n is a, c, g, or t
  misc_feature (3125)..(3125): n is a, c, g, or t
  misc_feature (3127)..(3127): n is a, c, g, or t
  misc_feature (3130)..(3130): n is a, c, g, or t
  misc_feature (3141)..(3141): n is a, c, g, or t
  misc_feature (3148)..(3148): n is a, c, g, or t
  misc_feature (3166)..(3167): n is a, c, g, or t
  misc_feature (3170)..(3170): n is a, c, g, or t
  misc_feature (3176)..(3176): n is a, c, g, or t
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaaaaagggggggggggggaccgcggtcnnanaaaggaaganaggttgatgaatttggccatggtgacactggtgatgancntcctttattccaaaagaanaaaaggnaaaaggggntgacgangaanncnaaaangnggaggtggnggggggganganaaaaaaaagtnanagcnntccaanggganaaaagngctntttntttntaaantnnaaanggcccngnccntaaaaaacctntcacccnaagggaaaataaaaaggnnccnaaggcnaaaaggtggcgccctctccggagggtataatacccagggccatttccatgtggggacctttggggggggg

SEQ ID NO: 53453 - DNA, 3083 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggtaatgttactatttatggaaggtgactttgggtgaggcagtgatatttacatgggctgggaaagtgccacagtagggaacagaggttcctgaccttccacaggtcagtctttcacacttctcttggggactctctaatctttgccaggactttttcctttcagggaattggacaaaattgccttagtacaagtacttgagttctgggggaaaatacttttctattttacttatgtcagctatgtcagcctagtcaagataaaattcatgactctgagttatatgtaaagataatgttggaaatctttttagctgtgctttgagaggacatttatagtttggaaacttaacatagttggcagtattggcttatgataaactaagttaattttgctaattaagactccatacattggtatggtatggcaagtgtaatgcaaaa

SEQ ID NO: 53454 - DNA, 3635 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctgtaagtttatagtactgtgtttttctgtcccctagtagatgtgaaagattgcagtacactagaatacattctttccttgcagctttctcaagcacaaatgcttgtttacaaagttcatcagtggctgtttgattgtatcattgtaatgcaaacccaatttaacaagatggcctaatgtaagagtcttgactaatctattatgtttgacattctttagcccaagccagaacgtctgcctccatcaatgaagggaaaaataaaatccaaagccataatttcatcaagtgatgactcttcggatgaggataaacttaaaattgctgatgaagggaagggtaggatattttctctttgtaaattcttctcatgatgtagataaatcaaaagtgattactaatcagcctgtctgtactaagaaaaatatacttttctttctttataaataataagaggggt

SEQ ID NO: 53455 - DNA, 3263 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagaccttccaaggggaaaaaggtttggtttttttgaatacccaaatggctccaaaccaaaaaaacctaggcgcccaataaataagggttaaaaggggaaaaagccgaacgcgtttcgttaattaaaaaagggaaaaaaaacccccaacccctaattttctccccttggggactctttgggctt

SEQ ID NO: 53456 - DNA, 3308 bp, Homo sapiens
  misc_feature (2930)..(2931): n is a, c, g, or t
  misc_feature (2933)..(2933): n is a, c, g, or t
  misc_feature (2943)..(2943): n is a, c, g, or t
  misc_feature (2981)..(2981): n is a, c, g, or t
  misc_feature (2983)..(2983): n is a, c, g, or t
  misc_feature (3002)..(3002): n is a, c, g, or t
  misc_feature (3009)..(3009): n is a, c, g, or t
  misc_feature (3018)..(3018): n is a, c, g, or t
  misc_feature (3025)..(3025): n is a, c, g, or t
  misc_feature (3029)..(3030): n is a, c, g, or t
  misc_feature (3032)..(3032): n is a, c, g, or t
  misc_feature (3037)..(3037): n is a, c, g, or t
  misc_feature (3039)..(3039): n is a, c, g, or t
  misc_feature (3048)..(3048): n is a, c, g, or t
  misc_feature (3057)..(3057): n is a, c, g, or t
  misc_feature (3060)..(3060): n is a, c, g, or t
  misc_feature (3071)..(3071): n is a, c, g, or t
  misc_feature (3073)..(3073): n is a, c, g, or t
  misc_feature (3077)..(3078): n is a, c, g, or t
  misc_feature (3084)..(3084): n is a, c, g, or t
  misc_feature (3089)..(3089): n is a, c, g, or t
  misc_feature (3095)..(3095): n is a, c, g, or t
  misc_feature (3099)..(3099): n is a, c, g, or t
  misc_feature (3103)..(3103): n is a, c, g, or t
  misc_feature (3107)..(3107): n is a, c, g, or t
  misc_feature (3112)..(3112): n is a, c, g, or t
  misc_feature (3114)..(3115): n is a, c, g, or t
  misc_feature (3119)..(3119): n is a, c, g, or t
  misc_feature (3125)..(3125): n is a, c, g, or t
  misc_feature (3127)..(3127): n is a, c, g, or t
  misc_feature (3130)..(3130): n is a, c, g, or t
  misc_feature (3141)..(3141): n is a, c, g, or t
  misc_feature (3148)..(3148): n is a, c, g, or t
  misc_feature (3166)..(3167): n is a, c, g, or t
  misc_feature (3170)..(3170): n is a, c, g, or t
  misc_feature (3176)..(3176): n is a, c, g, or t
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcggtcnnanaaaggaaganaggttgatgaatttggccatggtgacactggtgatgancntcctttattccaaaagaanaaaaggnaaaaggggntgacgangaanncnaaaangnggaggtggnggggggganganaaaaaaaagtnanagcnntccaanggganaaaagngctntttntttntaaantnnaaanggcccngnccntaaaaaacctntcacccnaagggaaaataaaaaggnnccnaaggcnaaaaggtggcgccctttgggcaagggaaaattaaaaaccaagccctgattccccggagggatggcttttgggaaagcgataaatttaaatttgttttaagggccccaggaacgggaccgggggggcctgggg

SEQ ID NO: 53457 - DNA, 2596 bp, Homo sapiens
agcggagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctattgaaacttctaaaactaggcctagttttagaagtttcaatagcacctagtt

SEQ ID NO: 53458 - DNA, 865 bp, Homo sapiens
tatttcaattcgctaatagaagcacaattatcttcttgtctgctttcttaaatgttactggtaaactagtaattttgcatgtccaggtaactgcagctgctacagtcaatctgctttggaaagtcttggcattattgtgtcatttaatttaaaatttttaagtttttttagtttcttcccttattgaggacttattaggcgctaattagctttatgctagacatctcatgcatggcagtgaatgaaaacaacactgcctttgagggttttaacttgtatatagtttataccattttttttccaggttatagaatcaaagaaattgtttcaattcatatcacagtatttctctattaaatcaaatggtattttgcttgcataaatttaagtatccaagttgagatcttacatagaatctgttaatctaatattagtgttttcttcatttcattgtcttgggtttttttttcttaataattatttttcccaataccatccatttgttttgctcttacatttttaagtcttttatgttccaaatcaggtgacttacatcctccacttgtccattgaggatagcccagtaaacctttattctgactttaaattgcctccttgcttcaagaactgagttgcatgactcagttttctttgctagaaatatccctggatagtctcgtatgtattcttgatcaatgaattgcagaagatttgattaaaaattttaaatggatttcagggataaactatttgtatcaaatgtcatcaccaggaatttctacaactgaaaaatttgaattgttatttttattgaagaatatttatctttaagataaatgcaacttgctataaaatgatagaaatg

SEQ ID NO: 53459 - DNA, 234 bp, Homo sapiens
atgaagcagaggcaaccaacagaaattgacatcagaaactctgctggatccccaccagcatgctaccgatgaatcctgctctctttcagatgaatttttattttttttccaataaggccagccctaccctggaatctggaaccagttctggcccagggtagaaaggctaccaagcacctatggtagaagccctggtgtccaggcatgccttggaccttattattgaccttctct

SEQ ID NO: 53460 - DNA, 439 bp, Homo sapiens
cacacaccacactaccagcgaaaggagtgcctatttctccaccttcattgtttgataggtgaaaaatgtggttccctttaaaagtgataatcttgactagtagtgtggttaagcatctttttaaatgttaatgaccaattagttttcctcctctcgggaagagctcctcattgcctttgctttttgtcagttggcaggggttcattttgtcttaggaatgtataatcttttgtgtagctaatctttacaattatcttccagtctatttcttgtttgttaacagagtcaagaaaaagttcttaaaaaatacaatcacacaggtttatattttacttcaagacatctcagttatctgttttgcctcataattcaaaccataatgctttgattaacggaggctttttagtaaattttgatctgaaaaggcaaaaattcctta

SEQ ID NO: 53461 - DNA, 434 bp, Homo sapiens
cgtatttgtaagtatatcattgtggaaagtatttctaattacagacttactaagaaaattcaaaaactaactggatggttacacctagagaaatttatttaagttgacttggatctaccattatttaacactatgtcttcattaaagattagaggtgctcactgtaaagatgtcatgatactttaaaaggattacaatgatcattgtttaaatggtatttaatttttaaatgttaaacttttataccattttaaaagaacttcattttcaagtgttttgaaaatgagcatgtatgtgttttaagtattcctctgatatatctctaagtgaagattattgtaagttgtttctattataaaccacttttcatgtggtttcaatatcttgtattatattgttattgttattatagtttatgcagttattagcaaatg

SEQ ID NO: 53462 - DNA, 258 bp, Homo sapiens
  misc_feature (42)..(42): n is a, c, g, or t
tcaggatgcaaagaattatcatgcctggcagcatcgacaatnggttattcaggaatttaaacttttataccattttaaaagaacttcattttcaagtgttttgaaaatgagcatgtatgtgttttaagtattcctctgatatatctctaagtgaagattattgtaagttgtttctattataaaccacttttcatgtggtttcaatatcttgtattatattgttattgttattatagtttatgcagttattagcaaatg

SEQ ID NO: 53463 - DNA, 1741 bp, Homo sapiens
aacagttctgggggtcgtccgatcctgcaggtagtgtccgcgtgggaggggaggtgcagccgtcagcgctgccggcggctcccgttacgtgaattagtgagaggttcaaacttcttccccaggcttcagtgtcacatcttttcacacgggcaccccgagggcccggactggaaaggcgagccagccatctcgagactgggcgctcctgcccgccttttagtgcccatgtggccccatcctgggtgtgggagcggcggggcttccggggagggcgctgggacgcgcggacgaggccctccccgtttagggaatgggtggctttcggagtcttctgggggcccggcatgcccgctgcttgcggggcgtcccaggtggtgcaggacccgtgagacgctgaacctggggcctcgtaacgcctaggtttccattcgggcgctctggatgggtccgagactcggcatttctcacaggttcccaggaaacgatgccagcgctttgagtagcgaagaggtggagaaatagcccgggccgtttgcaagctttgaaggtccaggctctctttcacactcctcagtgtcatctcaaactgtcaaacgcagccacatccgttatacaatacatgttttgtagtaaaagtgttttgttgtgccgtaagatacagaaagtgtttttaaaaattaacttggctcttgcaatttggctgtctcaatttgtaattcacgtttggctcttacaactcactgtcctgtccgttttcaggaatgctcctgatgagtaagcattcaactcacaaattgctttcaaatgtaacaaaacaattttatgaattaaatttaacaggccgggcgcggtggctcacgcctttaatccctgcactttgggaggccgaggtgggcagattgcctgaggtcaggagatcgagaccagcctgacgaacagggtgaaaccccatctctactaaaaatacaaaaattagccagatgtggtggtgggcgcctgtaatcccagctactagggaggctgaggcaggagaatcgcttgaacctgggaggcagaggttgcagtgagcagagatggcaacactgcgctccagcctgggcgatagtgagactctgtcttaaaaaaataataatagtgaattaaatttaacagttaatttgatataatagtgtattttgtagacatttacttcaacatgtattgattttgatttttatcatttcatttgaatattgcagccaataattcttttttggtttttgcaagttatgcattgttttttatggtgaaaagttgaacataatatctaacactaggaggaggatagtcaaatttggttttggtagaaaataaaccctgtgcaaccataaacttgtttttcaggaatatttaagaacatttaaattgcatatcatataatgttaagtgataagtgaaattttaaaaagccaatatgcagcctagcgcggtggctcacgcctgtaatcccagcactttgggaggcagatgcgggtggatcacgaggtcaggagatcgagaccatcctggctaacacggtgaaaccccgtctctactaaaaatacaaaaacaaaattagccaggtttggtggcaggcacctgtagtcccagctactcaggagcctgaggcgggagaatggtgtgaacccaggagacggagctggcagtgagccgagattgcaccactgcactccagcctgggcagcagagcgagactccgtat

SEQ ID NO: 53464 - DNA, 1446 bp, Homo sapiens
aacagttctgggggtcgtccgatcctgcaggtagtgtccgcgtgggaggggaggtgcagccgtcagcgctgccggcggctcccgttacgtgaattagtgagaggttcaaacttcttccccaggcttcagtgtcacatcttttcacacgggcaccccgagggcccggactggaaaggttcccaggaaacgatgccagcgctttgagtagcgaagaggtggagaaatagcccgggccgtttgcaagctttgaaggtccaggctctctttcacactcctcagtgtcatctcaaactgtcaaacgcagccacatccgttatacaatacatgttttgtagtaaaagtgttttgttgtgccgtaagatacagaaagtgtttttaaaaattaacttggctcttgcaatttggctgtctcaatttgtaattcacgtttggctcttacaactcactgtcctgtccgttttcaggaatgctcctgatgagtaagcattcaactcacaaattgctttcaaatgtaacaaaacaattttatgaattaaatttaacaggccgggcgcggtggctcacgcctttaatccctgcactttgggaggccgaggtgggcagattgcctgaggtcaggagatcgagaccagcctgacgaacagggtgaaaccccatctctactaaaaatacaaaaattagccagatgtggtggtgggcgcctgtaatcccagctactagggaggctgaggcaggagaatcgcttgaacctgggaggcagaggttgcagtgagcagagatggcaacactgcgctccagcctgggcgatagtgagactctgtcttaaaaaaataataatagtgaattaaatttaacagttaatttgatataatagtgtattttgtagacatttacttcaacatgtattgattttgatttttatcatttcatttgaatattgcagccaataattcttttttggtttttgcaagttatgcattgttttttatggtgaaaagttgaacataatatctaacactaggaggaggatagtcaaatttggttttggtagaaaataaaccctgtgcaaccataaacttgtttttcaggaatatttaagaacatttaaattgcatatcatataatgttaagtgataagtgaaattttaaaaagccaatatgcagcctagcgcggtggctcacgcctgtaatcccagcactttgggaggcagatgcgggtggatcacgaggtcaggagatcgagaccatcctggctaacacggtgaaaccccgtctctactaaaaatacaaaaacaaaattagccaggtttggtggcaggcacctgtagtcccagctactcaggagcctgaggcgggagaatggtgtgaacccaggagacggagctggcagtgagccgagattgcaccactgcactccagcctgggcagcagagcgagactccgtat

SEQ ID NO: 53465 - DNA, 352 bp, Homo sapiens
gtggtgagccgagatagtgccactgtactccagcctggtgacagagcgagactctgtccaaaatatatatattttggatgggtgtattggttaattgctaaattttaaaattgtttattcttgattatatatcctacactgagccttggaagaaattaaaatataattacagtcttttcataatgcaatccttagattcagtaataccctttaataattatacccagttatttagtatctggaaatgtatctacataccaaattgtacacaaaaaaagtaaaataactacataaaccataaaatctctaaatcactttgccatcaagtgtgtttacaaacaaaatatgattg

SEQ ID NO: 53466 - DNA, 720 bp, Homo sapiens
tactaaacaaaatacaaaaaattagctggacgtggtggctggcgcctgtagtcccagctacttgggaggctgaggcaggagaatggcgtgaacccggaaggcagagcttgcagtgagctgagatgtgccactgcgctccagcctgggcaacagagcgagactccatctcaaaaaagtttacgtcactttttaaaataacatctggaatgtaaaaggggcaacacttttacaacattattcttttgtgtttaacttaattttttgaaaaccccagtacaacaggagccaattttttacctaaggaaagatgtttttctgtctcgatttactgctttgtgtatatcattttgtatttcctatagtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacgtgatcttcataataattaaatgagcatttaattattggtatatggttatattaaataaatacgttattttcagaacatga

SEQ ID NO: 53467 - DNA, 176 bp, Homo sapiens
agcaacttaagttgatgaagtctatccataccttcaatgactccggatgttcttctctctctgctgtgatttccccttaatttcaatttattagaaacataaatgttatccatgaatatatgtacttgtaagagctgtattaaaactttgtctgcagtctgacatctgggtcatct

SEQ ID NO: 53468 - DNA, 1584 bp, Homo sapiens
gaggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacgtgatcttcataataattaaatgagcatttaattattggtatatggttatattaaataaatacgttattttcagaacatga

SEQ ID NO: 53469 - DNA, 1809 bp, Homo sapiens
ggctcacaacactctaggaagctatgggaggtgaggcccgtagtggagaagaattgaaggagaaaaacggagggctgttctggtgtggcgcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacgtgatcttcataataattaaatgagcatttaattattggtatatggttatattaaataaatacgttattttcagaacatga

SEQ ID NO: 53470 - DNA, 1574 bp, Homo sapiens
ccagcacacctggttattttgacgtgtgtttgtttggcggggggggttttaccttgtttactatggtttttataccatgaaaacgtttttattatttattaattaattaaagctgtcattttcttttcttttgctctactgattctactgtaggcagaaatagtatagtcatgtaaaatatatgttaaaatgtaaattaaatgtattttttaaaatatacacttaattctttgttgctataatgtgttcctcttctaggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggtaagtgagatccttacaataaaatataataatatttttaatttgagctgaaatttgaagaaatcagttggagtgggagctcatttatgttgacattgatgactttttggcctttattttattttattttttgtatttttcgtagagatggaattttgccatgttgcccaggctggtctcgaactcctgtgctcaggcagtccacccgcctcagcctcccaaaatgctaggattacaagccactatgcccggccactttttggcttttaaacagtgatatggatatctaattctccataccaaataaatgcatatgactaagaggtgagctattagagcgcataattttattccataaaatttgctgagtgaattgaaagaagagactggataacttttgcgtgattttaaatgcattttagtgttgcgaaatgtcagaccagacattctttactaagttatgaattgttcataaatccagtggtacttgaagtgaatattgcagaaatgaatcagtaaaatattttaagatatttttggcttgtaaaagataaattcataagctcattaaggttcttgtgaccctcacaccagattttacctttgccattaatattgtttaaacatacatttttttctaggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacgtgatcttcataataattaaatgagcatttaattattggtatatggttatattaaataaatacgttattttcagaacatga

SEQ ID NO: 53471 - DNA, 1673 bp, Homo sapiens
gaggggcaaggcgagtgtgtgtccttatcctagcaattggggcgcgggcctgtgagccagttggagttgcggcggcgggaacgattgggctgagcagaggacgacatgttgcttttcgtggagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacgtgatcttcataataattaaatgagcatttaattattggtatatggttatattaaataaatacgttattttcagaacatga

SEQ ID NO: 53472 - DNA, 1725 bp, Homo sapiens
gaggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatgagacggagttttgctgtgtcatccaggttggtctcttaactcctgagggcaagcgatccccccactaaggcctcccaaagtgttgggactatagacgtgagccactgcgcccagcatttgtgatgagtattttccatggatacagaatgcagggatgacagctaaaattattttccattcttttaagataccattctggactcttgtttctgatgagatgttcaccatcattcacatggttcttcccctgtatatgatgtgtcctttttctttgcctgctgtcaagatgttttatttttggtttccagtaggttggctatggtgtgtctagtatgcttttacttattatacttgggaaatactaaacttcttggctctgtatgttgatattctttactgcatttggggaatttccaaatacttgccaaaaattttttctgccctctcttctcctttctttttttggtactccaatttcatatgttggactgattgatgtcactgagattctgttcatttttcttcaacctatttttgttgttgttgttgttctccagattggatcatttctgtggatttgggttcatcttcaagttcactgaacttttcttttgctgtccccaatgtgataggactgtccagtgaatattttagatgctgtattctagagtttccatttttcaaaatatttcttctctctctgctgtgatttccccttaatttcaatttattagaaacataaatgttatccatgaatatatgtacttgtaagagctgtattaaaactttgtctgcagtctgacatctgggtcatct

SEQ ID NO: 53473 - DNA, 827 bp, Homo sapiens
  misc_feature (808)..(808): n is a, c, g, or t
ggctcacaacactctaggaagctatgggaggtgaggcccgtagtggagaagaattgaaggagaaaaacggagggctgttctggtgtggcgcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacaggccaccttnagaaatggggatcctcaga

SEQ ID NO: 53474 - DNA, 502 bp, Homo sapiens
aggaggattgcttgagcccaggagtttgagaacagtctgggcaacataatgagagcctgtctctacaaaaaaataaaaataaaaagttagctgggtatcatggcacaagtttgtggtcctagctactcaagaagctgtggtgggaggatcatttgagcccaggaggttgaggctatactgagctgtgatcacaccactgtactctagcctgggcaacaaagggagaccctgtttctctgaaacaatagctttgtggtgaattttgattgtagatactttgtggcttctgagtacaacagtatgtcagatttatcacctctactaacatgctattaactttttttccctcttcttttctaccatcaggagaaagcaattcagcagtttctacagaagacctaaaagaatgtctgaagaaacaattagaattctgtttttcacggtattgctgtttcccctttattgaattttattagtagatgtaaaatacgtgtgaaataga

SEQ ID NO: 53475 - DNA, 583 bp, Homo sapiens
gatgtaaaaattgaacctggatgattgatggggcaaaatacatttaatcaatttatacattttatttctgttttacagcatttatggggttaagtggcatgggatttctgtttctgatagtaaataggtaagtaaaacaaaaggttatgtatgtccgaagagacggttttaccatatttatggtgattttcttcctaactcatggttctgttaccttaggtctgtaatttcttaggacaggaggataccattttcacaagaatttgatggttctctttttcctttcatttttatctctctgaaggtagaatttagcattaaatgggacaataatcaggactgcctttggcttatttggggatgacatattgcttagaaataagggtggtgattgaagcatcagttttacagatagtttagatctttttgttgagtatctatgtgcttgcatactatgtatatgttggcagatagtttagcatgcatttggacagtttacatcgtttagtagatatttataaaactgtaatctcaagggcttctaatcctgtggaagtgatcaagattttgatggcggtctaaa

SEQ ID NO: 53476 - DNA, 1633 bp, Homo sapiens
gaggggcaaggcgagtgtgtgtccttatcctagcaattggggcgcgggcctgtgagccagttggagttgcggcggcgggaacgattgggctgagcagaggacgacatgttgcttttcgtggagcatttatggggttaagtggcatgggatttctgtttctgatagtaaatagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacgtgatcttcataataattaaatgagcatttaattattggtatatggttatattaaataaatacgttattttcagaacatga

SEQ ID NO: 53477 - DNA, 1501 bp, Homo sapiens
cctggtggcgaattcggcacgagggttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacgtgatcttcataataattaaatgagcatttaattattggtatatggttatattaaataaatacgttattttcagaacatga

SEQ ID NO: 53478 - DNA, 1438 bp, Homo sapiens
gaggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcttactccccaagggttttccaattacacgagaccgcacggtaggtaccggactttttacaaacagt

SEQ ID NO: 53479 - DNA, 345 bp, Homo sapiens
  misc_feature (163)..(163): n is a, c, g, or t
ttttttgtgactggcttatttcattcagcataatgtcctcaacgtttatccatgttgaagcatatgtaagaacttccttcctttttaagactgaataatatttcattgtgtgtatatatcacattttgatatctgtccgttaatttatgggcacttgtttttnccatgttttagctattatgaataatattgctatgaacagtctttagtaagaatcatttgaggggaagagaaacacaaaatgacagcggtaactgccaaagcttctctttgggagtttattgatattcctaaatgataggagaaggaaaactgatggaagaaaatgcaacagcctttaagggg

SEQ ID NO: 53480 - DNA, 204 bp, Homo sapiens
gggtgtttttttttaaattgttagtcctactctcccttaccacagccctttcgacagaacatcgtctatcattaccctttgtatccccaggggctaaaatatgtttggtacataatccaagcttaaggcacaattgtgggagaaaattgttattaaaataaaccaggggaatacaacagtaataaaagctggcagtctaaaagc

SEQ ID NO: 53481 - DNA, 425 bp, Homo sapiens
gccttactctatgaacccaaataattccctgagtctggctcccaagtccattctacagggaagaggattaagttctaaaaacttaaaatgctgacaattttgctatagcttcatgaaattgatcccaagaaccaggaactatcatgatttatagaaagatagatgttgtattagcttttgttcacggggaatctcagatttgttgaatgatctgatgttcagattagaagcagccacgagcccctgaagaagcaggccgaatgcagcaggggaggtctgtgctccagtcctggatttgtcgtttcctttctgcatgtgctggagcaaaccacttattgtctgtcagcctcagtttcctcatctgcatgcactgatgaccataatcctggcaatgacacaactttgctgtgaggctctcatgagag

SEQ ID NO: 53482 - DNA, 632 bp, Homo sapiens
tggactctcaccattcagtggatgaagagtacttattgctagaatgttcttcctcatatgaacttgacaacgttctgctctctaattccatttatttagctgtttcgaattgaatttgacagtttctagatccctgcagttggaatgatttaaggccacgggagtgaatctcaggtcctcagttttcattctcccagggttatgaataaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatgga

SEQ ID NO: 53483 - DNA, 597 bp, Homo sapiens
agcggaggtaaagaagaggcatggaggtgaatgcaggcagcagctttcagggaagaagaagcatcaggctgcagaccttgcctcctccctgccctgatggcaggactgaggcctcccagggatgaagaaactgaggctgaggcagttcaacaacttgcccaaggccacgcagcaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatgga

SEQ ID NO: 53484 - DNA, 345 bp, Homo sapiens
tgagacggagtctcactttgtcgcccaggctggagtgcagtggtgtgatctcggctcactgcaagctctgcctcccggggtcatgccattctcctgcctcagcctcccgagtatctgggaattacaggtgtgagccaccgcgcccggcagcattattttttaaagatctgtgatagtgcatgttgtgctagttctttaatacagactatattgtattccatgtcagtttttaaagtttatttccctattgatggcatttaattccaacttttagataaaaggatgtactggacatttttataatttttttgggggaccatgtaagagtttttctagggggaattc

SEQ ID NO: 53485 - DNA, 111 bp, Homo sapiens
ggttaaagtcagttctaaagaaatgacatgataacccggcatacaatagcagatatcttctcaaatctattcaaagaattagctaagacagaattcttaaaaatccaagct

SEQ ID NO: 53486 - DNA, 405 bp, Homo sapiens
cctggggctaagcatcctctcacctcagcctcccaagtagctcagaccacaggcacaccaccatgcccagctaatttttttttattttttgtcaagatgcggttttagtatgttgtccaggctggtctcaaactcctgtgcgtaagtgatcctcccattctccctgttcttaccagcatttgactttgtttagggcagcaacgtgtttaacggaggccccattgcctctgctgagtggggagaccatgtgacaggacactagccactgagaggtaagggaagccactagctatggcttgggtggatatttaaagaagggcagagccagggccaggagcagtggctcaaacctgcaatcctagcacttttgaaggccaaggcgggaggactgcttaagcccaggag

SEQ ID NO: 53487 - DNA, 2356 bp, Homo sapiens
  misc_feature (1098)..(1098): n is a, c, g, or t
atcaaaagaagttcaatactaaagataaagagttttccttattgaaatatatattgttaagcttttaaaccaaatgaaagtatgagtggtcatatttatactgtagtaggttttcataatagattttccagattaaaaccatttgttgaaatcatcaaagagatgttaatcctgctttagcattgatgcaaagttaaaataactgacattaaaaaaatcatttgggaagctttattgaatatattgagataaggtttattgtagtccttctcttcatgcatactgctgttacaattccaggaggtttcaaaatccatgtgaatgaccccattcaaccctcaaactgtccaattcctggcctaattcaccttcactctgctgtagctaccagttgcaggactagctgcattttggccagaactgcatcaccctggaaattttaaacacactctctctcttctgattgccctctttttctggttccatctcagctttattcccactgcattgttctttatctttggagctctctaaatccctagctgtgctagtggtggatgaggtgtttaacaaaggaaatgtaagatcttcctttagttgccagttcagtgtagttttttggaattagtttgctaaatttcttttaaagtgatcagtttagtatccaagaagtaaaatggagcaagttgaaaaattgtcctgcctgtgtttcagtttaggttgttcctaggcgcactgctgacttctcttatgaccttgggtagattcagtctttattggtatttgaacttttaatgtctgttgtgtactctccttagacacatttaaaactttaaagcatttgggcagggggaatgggtaaggatccagttttatttaagactgtcaggacccatctcaatagtagtatctattcccatgagagaaaaatgaaaggcaaggcttacatcagcctagtctcctcacttaggaatcacaacattcctaaggtcagaaacagtgtgaagtaagtctctgaacccattttggagggcagtacatcagaaatacagtggaaattgctctttagctggatgtgagtttcattttaagcaccantgtttatattctttatgtcttgcctttctttttatattgagtttgtttcaccttgtaaaattaagaagagcatgttctagcttttaaatgtgagaattgaattattaatagttttgggtaaaagtatcacctcccatttcttctaccaaaagcagcacatcctcacagacttttcacctcactgaaaatggtcatttaaagtttttactaattcagcatttaaagctttttatttcctccttgatttataacacagctgtttcttgaatagaaaaaactcaaggactacatgcaatctaattagattacattctttgtgtgagtctcctgcatttagtggaggccactaatcaaatcttgatatattttctatttcttttatttatttattcatttaattcatcaagtcaagatggctataattagagcagattactcctaccacattgtattatgatgatctcttcatgtttttttgtttcatactatatgatattcattaagggtagcattgtgccatcctccatcaagcattatatgcttcctttgtgcttatgatgttgaccgtagcaaccttaaactgttaagacttgtttataaacggtgaagctccatcattccaacagagtcagcatgctaattcactctagttcaaatccacattctagttgaatccctgcaatgtaacttgacatttggagaaattgattcataccattttaaagaaatatgatataggtgacagaatccaggatgaagaggtaccttgttgcttagatgatgacgttgtggattcatttcacatctctctctctttttaatgtagctcttctccctccttggtttttattcctccctccttctttcttcttcaagcctcctctaatgttaacatctttggcagtttggccagtgttgacaactactttttgattatttggtattttaaaatatttggtattttaaaatgcttttattggccaggcgtggtggctcacaccttataatcccagtactttgggaggccgaggcgggcagatcatgaggtcgagattgagaccatcctggctaacacggtgaaaccctgtctctactaaaactacaaaaaattagctgggcatggtggcgggcgcctgtagtcccagctactcaggaggctgaggcaggagaatggcatgaacctgggaggcggagctggcagtgagccgagatcgcgccaccgcactctagcctgggtgacagagcgagactccatctc

SEQ ID NO: 53488 - DNA, 839 bp, Homo sapiens
atcaaaagaagttcaatactaaagataaagagttttccttattgaaatatatattgttaagcttttaaaccaaatgaaagtatgagtggtcatatttatactgtagtaggttttcataatagattttccagattaaaaccatttgttgaaatcatcaaagagatgttaatcctgctttagcattgatgcaaagttaaaataactgacattaaaaaaatcatttgggaagctttattgaatatattgagataaggtttattgtagtccttctcttcatgcatactgctgttacaattccaggaggtttcaaaatccatgtgaatgaccccattcaaccctcaaactgtccaattcctggcctaattcaccttcactctgctgtagctaccagttgcaggactagctgcattttggccagaactgcatcaccctggaaattttaaacacactctctctcttctgattgccctctttttctggttccatctcagctttattcccactgcattgttctttatctttggagctctctaaatcccttaaattcattgggtataggattctgtcatcttcatctttgtaatatcagtgcctagactaagcctggcgtataataggcactcagagatttgaagaataaatgactaaatgactgtatcaaatacttgcccattgtttgctgtttctgaattgtacaaggccatcatgataattgatgatcttaataatgtgagaatatgattctcttaccttagtaagagagccatcagtttattggatgatagttatatggaaaaagaagtaaatgctactgtgataaatatttataattttaaaca

SEQ ID NO: 53489 - DNA, 288 bp, Homo sapiens
tatgcctcaggtaatggacacttactttattattacactgagcaaaataatgaaaaccatacatccactgctgaagtggtattaacatcttccagttctttatataaataatcttgatagcccctcctatactccattagtgtctaaaatttagaatatatagtatagtacttgagtttagatcaatgttaacctacatggcaaaacctgccatgtttagtgtatttttttgtataaagtaggtttgatttttatcttacaatatttatcctaatgaaagttataaaa

SEQ ID NO: 53490 - DNA, 2275 bp, Homo sapiens
ctggtccgagggcagcccgaatatgtccctgggtgtgggtatgggtgtggggcaatttgggtgggagcagcgtggaggctccaaggaccaagtcctgcgcctctttggcggggtgtgtgcaggaggaggggggataaataggaggctccctcctcccggcgacattcacggagccggccggcctcccgccctgggtgtttccctgccttgtagccagggtgccagcctgggaagtagtttcgtttccttctgcctccgggattagtttccaggcaccctctcaggcgcccgaggcccgggaagggggcgaagaaggagggagacttgtctaggggctgcccggcccggcagagcggggttgatggaccgggccgcccggtgcagcggcgccagctccctgccactgctcctggcccttgccctgggtctagtgatccttcactgtgtggtggcagatgggaattccaccagaagtcctgaaactaatggcctcctctgtggagaccctgaggaaaactgtgcagctaccaccacacaatcaaagcggaaaggccacttctctaggtgccccaagcaatacaagcattactgcatcaaagggagatgccgcttcgtggtggccgagcagacgccctcctgtgtctgtgatgaaggctacattggagcaaggtgtgagagagttgacttgttttacctaagaggagacagaggacagattctggtgatttgtttgatagcagttatggtagtttttattattttggtcatcggtgtctgcacatgctgtcaccctcttcggaaacgtcgtaaaagaaagaagaaagaagaagaaatggaaactctgggtaaagatataactcctatcaatgaagatattgaagagacaaatattgcttaaaaggctatgaagttacctccaggttggtggcaagctgcaaagtgccttgctcatttgaaaatggacagaatgtgtctcaggaaaaacagctagtagacatgaattttaaataatgtatttactttttatttgcaactttagtttgtgttattattttttaataagaacattaattatatgtatattgtctagtaattgggaaaaaagcaactggttaggtagcaacaacagaagggaaatttcaataacctttcacttaagtattgtcaccaggattactagtcaaacaaaaaagaaaagtagaaaggaggttaggtcttaggaattgaattaataataaagctaccatttatcaagcatttaccatgtgctaataagtttgaaatatattatttcctttattcctttcagcaatccatgagatagctattataatcctcatttcctacatatggaaacagggccaaagaagtcaagtcaaataatctaatccagatttagagagttggagattggtagagacagactagaaatcaagatttatctaaatcaaaatctatgctcttaaccatcatttttgttagtctgaatcggtgcaacctaactcaataatataacccaaggttttatactgaactgtgttttggtatgattgtgagatgtcaagaccgtcttcccacaggcacacagaatgagaaatcctggcctatattgctgttaccatcatgctttctatagaattggcttttattatgtttctttgctcctttataaattctcaatgatgtgactacatttttacattattaaagcaaatagattggccccataactagggaaatgaatagagatggaaaagtaaatgcttggcattccttaagccctgggtaagtgtttatgctcaataaaatgtaaataatattactgaaagaggctgtttatatgggagtaatggtcagtgacaacactggagagaccaggtagggaccggttgtgaccatatcctcatttatgttcttgatgacagcatatatgattgctctcaggtaaattttgatgcagtaaattcatgaccataacatctattacttgggaccatcttgccaagtgctcctttactccatgaaaaaacaatgctttaatgtttcttttttcctggactgagtttggttgaccaacaaaatctctcaagccattttgttttgatcctaaaatatcaatggtggctctcgaaatttggtagagctgatatcaagaaagaatttcaaagatttttatatcttttcaaaatgtattttatagttgctttgcatacactaaataactttgtttatgtaaactgtcaatattatcatgtaataaaataaatttattttt

SEQ ID NO: 53491 - DNA, 2128 bp, Homo sapiens
ctggtccgagggcagcccgaatatgtccctgggtgtgggtatgggtgtggggcaatttgggtgggagcagcgtggaggctccaaggaccaagtcctgcgcctctttggcggggtgtgtgcaggaggaggggggataaataggaggctccctcctcccggcgacattcacggagccggccggcctcccgccctgggtgtttccctgccttgtagccagggtgccagcctgggaagtagtttcgtttccttctgcctccgggattagtttccaggcaccctctcaggcgcccgaggcccgggaagggggcgaagaaggagggagacttgtctaggggctgcccggcccggcagagcggggttgatggaccgggccgcccggtgcagcggcgccagctccctgccactgctcctggcccttgccctgggtctagtgatccttcactgtgtggtggcagatgggaattccaccagaagtcctgaaactaatggcctcctctgtggagaccctgaggaaaactgtgcagctaccaccacacaatcaaagcggaaaggccacttctctaggtgccccaagcaatacaagcattactgcatcaaagggagatgccgcttcgtggtggccgagcagacgccctcctgtgtccctcttcggaaacgtcgtaaaagaaagaagaaagaagaagaaatggaaactctgggtaaagatataactcctatcaatgaagatattgaagagacaaatattgcttaaaaggctatgaagttacctccaggttggtggcaagctgcaaagtgccttgctcatttgaaaatggacagaatgtgtctcaggaaaaacagctagtagacatgaattttaaataatgtatttactttttatttgcaactttagtttgtgttattattttttaataagaacattaattatatgtatattgtctagtaattgggaaaaaagcaactggttaggtagcaacaacagaagggaaatttcaataacctttcacttaagtattgtcaccaggattactagtcaaacaaaaaagaaaagtagaaaggaggttaggtcttaggaattgaattaataataaagctaccatttatcaagcatttaccatgtgctaataagtttgaaatatattatttcctttattcctttcagcaatccatgagatagctattataatcctcatttcctacatatggaaacagggccaaagaagtcaagtcaaataatctaatccagatttagagagttggagattggtagagacagactagaaatcaagatttatctaaatcaaaatctatgctcttaaccatcatttttgttagtctgaatcggtgcaacctaactcaataatataacccaaggttttatactgaactgtgttttggtatgattgtgagatgtcaagaccgtcttcccacaggcacacagaatgagaaatcctggcctatattgctgttaccatcatgctttctatagaattggcttttattatgtttctttgctcctttataaattctcaatgatgtgactacatttttacattattaaagcaaatagattggccccataactagggaaatgaatagagatggaaaagtaaatgcttggcattccttaagccctgggtaagtgtttatgctcaataaaatgtaaataatattactgaaagaggctgtttatatgggagtaatggtcagtgacaacactggagagaccaggtagggaccggttgtgaccatatcctcatttatgttcttgatgacagcatatatgattgctctcaggtaaattttgatgcagtaaattcatgaccataacatctattacttgggaccatcttgccaagtgctcctttactccatgaaaaaacaatgctttaatgtttcttttttcctggactgagtttggttgaccaacaaaatctctcaagccattttgttttgatcctaaaatatcaatggtggctctcgaaatttggtagagctgatatcaagaaagaatttcaaagatttttatatcttttcaaaatgtattttatagttgctttgcatacactaaataactttgtttatgtaaactgtcaatattatcatgtaataaaataaatttattttt

SEQ ID NO: 53492 - DNA, 692 bp, Homo sapiens
ctggtccgagggcagcccgaatatgtccctgggtgtgggtatgggtgtggggcaatttgggtgggagcagcgtggaggctccaaggaccaagtcctgcgcctctttggcggggtgtgtgcaggaggaggggggataaataggaggctccctcctcccggcgacattcacggagccggccggcctcccgccctgggtgtttccctgccttgtagccagggtgccagcctgggaagtagtttcgtttccttctgcctccgggattagtttccaggcaccctctcaggcgcccgaggcccgggaagggggcgaagaaggagggagacttgtctaggggctgcccggcccggcagagcggggttgatggaccgggccgcccggtgcagcggcgccagctccctgccactgctcctggcccttgccctgggtctagtgatccttcactgtgtggtggcagatgggaattccaccagaagtcctgaaactaatggcctcctctgtggagaccctgaggaaaactgtgcagcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctg

SEQ ID NO: 53493 - DNA, 466 bp, Homo sapiens
aagatgtccttattgacaaagccaggctctaaggagactaactgaagacagggttatttcaaaagcaaagaccatgtcatccaacaggaaaaaaacaccgctaaggatgcttactcctgcatagcaacaattggcttgtatgtatgttacaaagaacagaaaatgtggttgtgtctttttaagatccggtaggaaactacatgaggcctggtcctgtgggaaaatgtgctacaaattgacactcacttgatgctgaacttactgtatttgaactttaaaacaaatctcctaattattttgatcttctgtactataatcaaacattctggcacatattcttttcgaatccctgaaatgtctgcttcaggtatcttgttgaatacttattatagaaaagtctagttctagatggcaagagcagatataaagattaaaagcccagcctttacctttacacagctcgcag

SEQ ID NO: 53494 - DNA, 371 bp, Homo sapiens
aaattagggaagccgtcagttattaatcaagttctggccatttggggctgattgttacggaggttattatttagctcctgaattgtcactagagataacaatctcacttcctgcaagttggacttatatcaggctggcttcctgggttgtttattataaatataagggttggtctcccaggcagattgctgcagattgtgagttaaagttctagttttatatatggtctggccattgtccatttgcatattcagtctctcaacaaataaacgatgtgacatccaaacaatagtatataattcagtgctagaaagaaatgtgttatcaagccataaaaaaatgaaggcaacttaaatgcatattactcagtg

SEQ ID NO: 53495 - DNA, 1178 bp, Homo sapiens
attatgctgacctctgacgagctgcaattggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattccttttt

SEQ ID NO: 53496 - DNA, 1758 bp, Homo sapiens
caggcttccttcctgaattaaggaatatactggctctggtaaatattttctctgaagaaaagagaaggatttttggtccccttcattcttggctttttactcactgagattctgcccattcgtgtgttagacaactgtgtgtggaatgttgttgcataccaggcactgttctttgtgcgtggaataccacagtgtataaaacagtctctgtcctctttgagtttaaattctgcaagaggaaaatacataataaacaataaataaccaatataatggtgcaagtgaaagtttggtaaagaaaaggatgaggttggaggggtgtagcgaggagtggctggttgcgggtgctgtttgcttcagcaaggaaggttcgagaagccctctcaaagtagttgacatttaaacagggacctgacagatgagaaggacccaagcctttggaagagctggaagaacactccagccagaagaaacagcaagtgcagagggcttgaggtctagtggtggctgaagaacagaagggccactggagagtgaggggacatggtgagagaagaggtgaagagtggatgggccctctgtgacatgtgaaggagttcggatattattctcagtgcagtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattccttttt

SEQ ID NO: 53497 - DNA, 1570 bp, Homo sapiens
attatgctgacctctgacgagctgcaattggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtaccgtaaaagttgtgggaatgtgaccccatcccagggatgccaaaattctctcatctttggataactaacactacgcaggg

SEQ ID NO: 53498 - DNA, 361 bp, Homo sapiens
agtaagctattacccccacattaattgaaattcccaagcatatacaagaagattgggaggaagtcagaatcagcatctgtctttgagttttggcagaataactaacacctgtttgatggaacatctccagaatcccattatgaccttcttaggttatgatggtttgaacctaggaagtctgttgatacctgtttggataactcagcactgaatggttgctgtctgaattgggacttgattgttattatgtgtctgtccttaggtctggcgggaatttcctgaccggttggtgggttacccgggtcgtctgcatctctgggaccatgagatgaataagtggaagtatgagtctgagtggacg

SEQ ID NO: 53499 - DNA, 291 bp, Homo sapiens
ctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttt

SEQ ID NO: 53500 - DNA, 1209 bp, Homo sapiens
atggcatctctgagtcagctgagtagccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccaacaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 53501 - DNA, 1111 bp, Homo sapiens
atggcatctctgagtcagctgagtagccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccaacaaaccctctctcctgacccggcacatctggagctgaagcgttactacagcatctgccaggacactgccttgggtggaccaggcttccaagaaagaggaggagagttgaaaagagaggagaagactcggaattccctgagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 53502 - DNA, 305 bp, Homo sapiens
ggagagtaaagctttcattacttaaaaatatgtgtacaggtatatcagtatagttttaataagtaattattacatttataacaaaaatcattggtaatatataacattatgacaatagtctatttaattgtgtgactttctgacaattctttgcattgcatatctttatctatctgctttggccataagcaaatcactctggccagtagtataatgagctcagtaggattcctgttatctctcacactcaggaggcagagcattcgtaagttgaatacagactgccacgatatggtacaaagtac

SEQ ID NO: 53503 - DNA, 288 bp, Homo sapiens
agccaaactgattgctttaacttgtgcactctctgtcgccaaaggaatgcacattaaaatttatattgactcctaatatgctttccacatcctccacaaccatgctaccctttggactgaaagaggttttctcaccacacaaggctcttccattatcaatacctctctaataaaggccctccttaatgctgctctcttgctggccaaagctgggttcattcattgtaaaggacaccagaaaccaactgatcttattgctaaaggaaatgcctacgccaacaggacagc

SEQ ID NO: 53504 - DNA, 2560 bp, Homo sapiens
ctcaccctgaaggtgacagttccttggaaccttccctgatccttgtgatcccaggctccaagagtccacccttcccagctcagctcagtacctcagcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtgaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatcctatag

SEQ ID NO: 53505 - DNA, 2614 bp, Homo sapiens
ctcaccctgaaggtgacagttccttggaaccttccctgatccttgtgatcccaggctccaagagtccacccttcccagctcagctcagtacctcagcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatcctatag

SEQ ID NO: 53506 - DNA, 1738 bp, Homo sapiens
tgtaagccaagaagggcatgctctcgggtctgcccattcttgaagataccagcttaaaattcaccaacaccagcagcaacaatcaggtcagcatagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatcctatag

SEQ ID NO: 53507 - DNA, 543 bp, Homo sapiens
cccaagaaaagtcaagtggagattggtggaagagaaattgctgcctgaattctgccaaccttcaggcattctgattagcatgtgtgatttggtgcctgtcttttgtgacactgtgcacttgctatatcacccttgtgtttttgatcctgcaagttctggaaaagcctcgtagctcaacacattcttcctgccagtgcctgatgtagagtctttggatttatgcagaccccccaggttccttctggctcaaaaataaataaataaaaaataaattaaaaaaagctttaaggggctcagaagggggtttccagattaaactccacacaggtgtgtagaaatgcaaccagtcccaatggtaaacaagcatatctcctgtctcagaagcacccaggaactacaggcataaatatgcaataaagatgcactgacgggaggcaagctcatgttttataatgcatttctgtcttactcaacatctgagattccaggcacagtccagatcgtggctgtttgggttttgctaggaagaaagcacctttttta

SEQ ID NO: 53508 - DNA, 309 bp, Homo sapiens
tttgggaacagcaatttagctgaagagtagagctactctgctagaacaaaaatgggagataaaccaaaattaaggtgaatgtggagagccctgaatcccagtcgaggcaggagaagttcctggaaggcttctgagcaagggagagcaaggctcagagctaggcttgatgagggggattctggcaccagcaactggctgagtaggaggaagaagagcaggaagtgggaaccttccaggaaggcagtgaagacctgactacaggggcagtcagtgaagagtaggaaggatacaggagaccaagaagagggg

SEQ ID NO: 53509 - DNA, 371 bp, Homo sapiens
gtaccgggaatgaggtaagctttgacatgagggaaatgagtagctttgacacttaacatattgcttgaaaccttttttccatttgttgagtacatattaaaatctaaacacccccttaggtactagggatacaaatacctagaagttcaaatatttgcccttcaagagctcacattagggaagtcaacatgaacactaatagtccccatataacatgctaaatgctatatagttaaggtgtggacaacatgttaaaggatcacagaggaagttgttatactgcttggagtagggaaaaagccgacggacaaaatgacttttgaaaacatagaataaagaactgaggtatgtctggccaaccaatgtgtccc

SEQ ID NO: 53510 - DNA, 189 bp, Homo sapiens
aaatttcatgccaaatgaatgacgggcctataagtaaggtataatcctaaaaaatcttaatactttaagcaacagtattttgaattttgttcaacaaacctttataaatgatttttctgctttacaactatggctcaagaaaaaccataaaaataaagggttaactgaatggaagtgactactgaatgt

SEQ ID NO: 53511 - DNA, 220 bp, Homo sapiens
attttaagaacatttattgaattccaatataaatattcagtttaaccatataacactgttgatattttactatttttcacctattaaaaaatagcacatttggccgggcgcggtggctcatgcctgcaatcccagcactctgggaggccgaggcgggtggatcacgaggtcaggagatcaagaccatcctggctaacacagtgaaaccctgtctctacta

SEQ ID NO: 53512 - DNA, 2109 bp, Homo sapiens
gcgaggaatccgggggaatgtagtccctccgtgtcagtgacccgatgacatgcgctggttcttctaggactacatttcccagtgcgcttcgcgccccgccccggcgccccacccacggtcgcgcgcgatggtaccaccaggcgagggcggctctcgcgcgggccgccgggagtgtagttttctttgggagctgcggggcctggcgccggggccggggcggaagaaagactacaagtcccagggggcgcggcgccatcgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 53513 - DNA, 3056 bp, Homo sapiens
  misc_feature (1318)..(1318): n is a, c, g, or t
  misc_feature (1343)..(1343): n is a, c, g, or t
  misc_feature (1483)..(1483): n is a, c, g, or t
  misc_feature (1641)..(1641): n is a, c, g, or t
  misc_feature (1850)..(1850): n is a, c, g, or t
  misc_feature (1976)..(1976): n is a, c, g, or t
  misc_feature (2159)..(2159): n is a, c, g, or t
  misc_feature (2178)..(2178): n is a, c, g, or t
gctcaagcgatcctcccaccttggcctcccaaaatgatgggattgcaggcctgagcctccacacctgccctgaaaccagttcttctaagggaaaataagagtggtcaaagagtgtatagcacaatttaaattctcactaaatttttcattgccttgtagaaattttcatcccattatttagctttttggctccaatgagattttcaaaatagaaaatgcatgtgtttagttactaaggcataatttacatgcagtgaaacacacagagcttgtgtccagttcaattgttttgacaaaggattcaccagactcctgtcgtgatgtagaatctgcctgtgatccatggagattgcctcgcaggctgctccagcgcccgcctgccgcgccagacaggagcgctgctgtgattttaccgacactctgagtgttaggagtcacacgtgcgggcggttttgcgtctgccacggctcacgcagagaactgttgttgagcttcctctgaggtgctgcacaaggagtgggtgtgggatgcactgttgcgtgctcgtcgtctctgagggcgcccgggtgggtttccgctgtctgaagagttgggcctatttttgtgcacgtgtttggcgggcttgtgttgtttctcttgggaacgtgcccggggggaaggctgcatcccaggagttcaagatggcggtgagctatgattgcaccactgcactccagcctgggcaacagagcaaacccatctctaaaagaaagaaagaaattttaaaaaggaggaaaggaaagaaaggagaaaagaggaaaggaaaaaggaaaggaaactgttcccattaaacactaactccccattcctccctgccccccagcccctggcaaccaccgttgtcttttctgtctctatgaattcgacaaccctgggaacctcatgagtagaatcatacagtatttgtcctgttgtgatgagctgctttcacttagcatagtgttttcaaggttcattcctgttgtagcatgcgtccaaaatttcttttcaggactgtagaatattccacggtctgtatagaccaccttttgtttatccattcatctgtggtgaacaatgctgctgcagacatggtggctgtggtgaacggtgccgagacatggtggctgtggtgaacggtgctgccgagacatggtggctgtggtggacggtgctgctgagacatggtggccgtggtggatggtgctgagacatggtggctgtggtgaacggtgctgccgagacatggtggctgtggtggacggtgctgctgagacatggtggctgtggtggacggtgntgctgagacatggtggctgtggtgnacggtgctgagacatggtggctgtggtggacggtgctgctgagacatggtggctgtggtgaacagtgctgagacatggggctgtggtgaatggtgctgccgagacatggtggctgtggtgaatggtgctgctaatgtgtntagaattggtggattcttggtctcactgacttcaagaatgaagccgcagaccctcgcagtgagtgttacagttcttaaagatggtgtgtccggagtttgttccttctgatgttcagatgtgtttggagtttcttccttctggtgggttcgtggtctcnctggcttcaggagtgaagctgcagacctttgcagtgagtgttacagctcataaaggcagtgcagacccaaagagtgagcagcagcaagatttattgcaaagagcgaaagaacaaagcttccatagtgtggaaggggacccgagtgggttgctgctgctggctccggcagcctgcttttattcccttatctgaccccacccacatcctgntgattggcccattttacagacagctgattggtccattttatagagagctgattggtctgttttgacagggtgctgattagtgcgtttacgatccctgagctagacacagaatgatatttacagtcntctagctagacgtaaaagttctccaagtccccactagattaactagacacagagcagcgattggtgcatttacaaaccttgagctagacacaaggtgctgattggtgcgtttacaaaccttgagctagacacagagtgctgattggtgtatttacaatcctgtagctagacataaaggttctncaagtccccaccggattanctagatacagagagtgctgattggtggacggtgctgctgagacatggtggctgtggtggacggtgctgctgagacatggtggctgtggtggacggtgccgagacatggtggctgtggtggacggtgccgagacatggtggctgtggtgaatggtgccgagacatggtggctgtggtgaacggtgctgccgagacatggtggctgtggtggacggtgctgctgagacatggtggctgtggtgaacggtgccgagacatggtggctgtggtggacggtgctgctgagacatggtggctgtggtgaacggtgccgagacatggtggctgtggtgaacggtgccaagacatggtggctgtggtggacggtgctgctgagacatggtggctgtggtgaacggtgccgagacatggtggctgtggtggacggtgctgctgagacatggtggctgtggtggatggtgcggagacatggtctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 53514 - DNA, 2266 bp, Homo sapiens
gcgaggaatccgggggaatgtagtccctccgtgtcagtgacccgatgacatgcgctggttcttctaggactacatttcccagtgcgcttcgcgccccgccccggcgccccacccacggtcgcgcgcgatggtaccaccaggcgagggcggctctcgcgcgggccgccgggagtgtagttttctttgggagctgcggggcctggcgccggggccggggcggaagaaagactacaagtcccagggggcgcggcgccatcgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagggccggcccccgcagggtccctgccaggcagatggtccagccagcagttcggaccccaagctccggccctgcagcctggcgaagccgtaagtaacccacatcatccgggctgagcgtccctggccgcgtgtgcctgtgccaggccatcccgagtcctcactctgcctttctctccttttcaaggctgcaatgatccccccgccacagtcctcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 53515 - DNA, 2281 bp, Homo sapiens
gcgaggaatccgggggaatgtagtccctccgtgtcagtgacccgatgacatgcgctggttcttctaggactacatttcccagtgcgcttcgcgccccgccccggcgccccacccacggtcgcgcgcgatggtaccaccaggcgagggcggctctcgcgcgggccgccgggagtgtagttttctttgggagctgcggggcctggcgccggggccggggcggaagaaagactacaagtcccagggggcgcggcgccatcgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 53516 - DNA, 2029 bp, Homo sapiens
cagaacctcagcgagcggactccagttatattccgtgctcttgtcggcacgcatttcacttctaggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagggccggcccccgcagggtccctgccaggcagatggtccagccagcagttcggaccccaagctccggccctgcagcctggcgaagccgtaagtaacccacatcatccgggctgagcgtccctggccgcgtgtgcctgtgccaggccatcccgagtcctcactctgcctttctctccttttcaaggctgcaatgatccccccgccacagtcctcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 53517 - DNA, 2553 bp, Homo sapiens
  misc_feature (2156)..(2156): n is a, c, g, or t
gcgaggaatccgggggaatgtagtccctccgtgtcagtgacccgatgacatgcgctggttcttctaggactacatttcccagtgcgcttcgcgccccgccccggcgccccacccacggtcgcgcgcgatggtaccaccaggcgagggcggctctcgcgcgggccgccgggagtgtagttttctttgggagctgcggggcctggcgccggggccggggcggaagaaagactacaagtcccagggggcgcggcgccatcgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaagctgcaaaaaaaaaaaaaaaaaaaaaaaaaaaaaaaaaaaaaaaaaaaaaanaaaaaaaaaaaaaaaggggggggggccaaaaaaaaaccccgggggggccccaaaaacaccaagaaattataagaagaaggaggggtcgccaacaagagaggagagcgcgaataaaaaaaacaaggaagccacggcgcggcccaacaataaaaaagcaagtgcataggtgggaaaaaacgtgtagagccattggaacatatttatagggaagaacaacacaatatagaaggggggggcaagaaaatattggggaaaaacaaactcaccaagacattatataaaggcttcaagaggaaaaaaaaaaaatatacagtatatagatggttgaaaaaacaggaggaataatggcgcgagtaaaaaataaacaaaaggagatataattaaaaataaaatcccg

SEQ ID NO: 53518 - DNA, 2378 bp, Homo sapiens
gcgaggaatccgggggaatgtagtccctccgtgtcagtgacccgatgacatgcgctggttcttctaggactacatttcccagtgcgcttcgcgccccgccccggcgccccacccacggtcgcgcgcgatggtaccaccaggcgagggcggctctcgcgcgggccgccgggagtgtagttttctttgggagctgcggggcctggcgccggggccggggcggaagaaagactacaagtcccagggggcgcggcgccatcgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggacactgatgtcccagccccagaggtgctgaccaggtccactgctggggtcagaggggcctgtgcctcgcagaggggagccctccgctgcctgctgggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 53519 - DNA, 2422 bp, Homo sapiens
gcgaggaatccgggggaatgtagtccctccgtgtcagtgacccgatgacatgcgctggttcttctaggactacatttcccagtgcgcttcgcgccccgccccggcgccccacccacggtcgcgcgcgatggtaccaccaggcgagggcggctctcgcgcgggccgccgggagtgtagttttctttgggagctgcggggcctggcgccggggccggggcggaagaaagactacaagtcccagggggcgcggcgccatcgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcagccccactccatctctttggctccgcatgctcctccctgtggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgtaagtaacccacatcatccgggctgagcgtccctggccgcgtgtgcctgtgccaggccatcccgagtcctcactctgcctttctctccttttcaaggctgcaatgatccccccgccacagtcctcagacgtggggtctgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 53520 - DNA, 1062 bp, Homo sapiens
gcgaggaatccgggggaatgtagtccctccgtgtcagtgacccgatgacatgcgctggttcttctaggactacatttcccagtgcgcttcgcgccccgccccggcgccccacccacggtcgcgcgcgatggtaccaccaggcgagggcggctctcgcgcgggccgccgggagtgtagttttctttgggagctgcggggcctggcgccggggccggggcggaagaaagactacaagtcccagggggcgcggcgccatcgcctgagggcggggtgtacgaaagagaaacccggagggcgccggggactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggcccagctgcccgagtgctgtgtggatgtggtgggcgtcaacgccagctgcccaggcgcaagtctgtgtggtccaggctgttacaggcgctggaacgcggacgggagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgtaagtaacccacatcatccgggctgagcgtccctggccgcgtgtgcctgtgccaggccatcccgagtcctcactctgcctttctctccttttcaaggctgcaatgatccccccgccacagtcctcaggtaacagcagctgtcgcatccccctg

SEQ ID NO: 53521 - DNA, 339 bp, Homo sapiens
gcaccgtaggccacggcccacctgggttgccctcgcgtgaccacggcctcacctgctgtcttcatctgcaggactgggccggggtctgcagggctcagctgagcccatgagctcccagagctaacccctgaacacccaggcgggcaaagggctgatgtcggtagtccccatcctggaggggcaggtaaggccctgcctacacctcgccccacccgtgcctccaaaggccccaagccttcactctttcaccccacctccatttggctccaccttccctgtcgtggccctgcacccctgccacggccctgccccatctccatttaactcagtcatctgccg

SEQ ID NO: 53522 - DNA, 482 bp, Homo sapiens
caaggttcattcctgttgtagcatgcgtccaaaatttcttttcaggactgtagaatattccacggtctgtatagaccaccttttgtttatccattcatctgtggccgtggtggattgtgccgataactggtggctgtggtgaacaatgctgctgcagacatggtggctgtggtgaacggtgccgagacatggtggctgtggtgaacggtgctgccgagacatggtggctgtggtggacggtgctgctgagacatggtggccgtggtggatggtgctgagacatggtggctgtggtgaacggtgctgccgagacatggtggctgtggtggacggtgctgctgagacatggtggctgtggtggacggtgccgagacatggtggccgtggtggatggtgccgagacatggtggctgtggtgaacaatgctgctgcagacatggtggctgtggtgaacggtgctgccgagacatggtggctgtggt

SEQ ID NO: 53523 - DNA, 720 bp, Homo sapiens
gttcttctaagggaaaataagagtggtcaaagagtgtatagcacaatttaaattctcactaaatttttcattgccttgtagaaattttcatcccattatttagctttttggctccaatgagattttcaaaatagaaaatgcatgtgtttagttactaaggcataatttacatgcagtgaaacacacagagcttgtgtccagttcaattgttttgacaaaggattcaccagactcctgtcgtgatgtagaatctgcctgtgatccatggagattgcctcgcaggctgctccagcgcccgcctgccgcgccagacaggagcgctgctgtgattttaccgacactctgagtgttaggagtcacacgtgcgggcggttttgcgtctgccacggctcacgcagagaactgttgttgagcttcctctgaggtgctgcacaaggagtgggtgtgggatgcactgttgcgtgctcgtcgtctctgagggcgcccgggtgggtttccgctgtctgaagagttgggcctatttttgtgcacgtgtttggcgggcttgtgttgtttctcttgggaacgtgcccggggggaaggctgcatcccaggtgtggaagtcccagcggttctgtgtgtccccacagccgagaggctgagtgccgtttggtcgtggaggctttagtttgcatttccctgacgctcacccgtgttgagcactgtccactcatctgttgc

SEQ ID NO: 53524 - DNA, 732 bp, Homo sapiens
ccactctgacctcgcctgtctctgacccgtttcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgc

SEQ ID NO: 53525 - DNA, 478 bp, Homo sapiens
accttaagaatacgacaagttggattggtttttatgttgcagtgctctgatttctccctgatgtccaagagttgaaacgtgaccaaaagggaaataaagtggtcttttgtttccagaagtcctaaatggcgattcccccggcaagaatcctagggcctatgagggccgtgaccttttccttaaagcagcagttgtgatcagtgaggctggccctaggtttacaagaacaggccctgaaaggtaacccattttctcctttgaaaagcttactagactgataagttaggggaaagtggtatttgaggaatcctctcatgagaacagagtagaaaagtacaagctgggccagcgccgctaagtagattagttgactctttggactgtgatatttataacatgccaattaaagtaggaaagggcttctgctgatgtgccacagggctgtttttctactgattttgccaataatttggatgaa

SEQ ID NO: 53526 - DNA, 153 bp, Homo sapiens
ctgaacaggttggaacacgttttctggaggatgggacattgaaactgaatcacctacaatgttgaaggcagatggtaacctaagaaaggtaaagccttgttaatcaaatcaattcttttcactttaactgtattggaaagatactttaaaaaa

SEQ ID NO: 53527 - DNA, 271 bp, Homo sapiens
tattcacgttattaaaaaacattcctcagttcggtaaagtatttggtagcaagctcctataagtagagagagtttctgatgtatttgagtacagatcaattacaacttgaaggagaggttggtgcattgctgaagaacttttaataaagttgcaggtgctgtcagaaatggaaccatacctgaaaaataataactgaaatttcttcagttccatagcattgcaaaacttacttccgcatttgctcatgtgatatatgggatttccatctct

SEQ ID NO: 53528 - DNA, 396 bp, Homo sapiens
aaatatcctaaatgcatttattggcactctcagaaactattaagaaaatttaaaaatagatacattaatatcatggtaggctaatactacatagattgtctccagctcatgaacccagtggaagaaactgggcaagagataagtttaagtgttttagaaagcagaactaatagaacatggtctttggccagtaaagtctatacacacacatgttatggtggcttccacgtgtgagcaggcctggtgaagctgggaaaggagtagagggcccttcagacctggcctggagagctggtggagcaaccggtcagtcgtcttcggtagttagtggtgggttaccaggtcagtctctcccagggacctgaggacccgggttatgagaaacatggcttttca

SEQ ID NO: 53529 - DNA, 430 bp, Homo sapiens
catatccccgttttctgagggggctggtgagaccattatcccggtagcagtgtaaaggggcctcagaagccgtgcggtgcctgagatcctcctcctcctcccatccgggaaaccacctctgctgctctgactgtctgaagctaacctcctgggcttcctgcttgaggcagaccttcatgaacaggcttaagccacccatcccgccttgggacacacatgccgccctctcggggaccttggactgggaccttgccattctgctcctgctggggaggtcgtgccgcctgtttctctctgtgtgtgagtttgcaggttcccagaggcagagactgggctttgcgacagctcccctcccccaaccctcgatggacaaggagggcccttgtcattcctcagacattttgttccaaagctgaaaggtcccctccac

SEQ ID NO: 53530 - DNA, 336 bp, Homo sapiens
tatttttcagatatggataaaaattgcttaggagagtaaagagagacaaagttgaaagcaggtttatagtaggtgttgttttagtgttgatccctttttgctccaataatcaaagtgataaatattgaaaattgattcatgcagcattacttactccattctaatttttatatatgtcaaaagtgccatctcccaaactgtgctatccccttcaggagaagagactctgctgaagtttataaggttgacatattgccagcttcaataatgtaaagatgaagtgtatactgaattcttaatgcaaataacaactctattggaaagtaatccagttat

SEQ ID NO: 53531 - DNA, 207 bp, Homo sapiens
atattacagattaaaagccattataattattttctatagataacgtttgcttaaatttacctcatgtttatcagttccttaccattccttcttgcatctcagactttccttctgtgatcattttccttctccccagagtatatcctttagaagttcctttattgtatatagacctgagggtaataaacattttcattgttttcctgt

SEQ ID NO: 53532 - DNA, 669 bp, Homo sapiens
aactctagccctagaagaaactgtatatgagagggggacggctagcctccaagggatttgggaatgatgcatgattctacaggttgcatcttctaagctgcaagtcaagagctcagcatctcccagaaatgcctgttctgagctccatggaagtcctacgtgagtgccttgtccaaaatattggctcagttcaaagtttatgtctcagtgtttccttcctgagagtatccaaagaagatctcagccttctgtgattttgctctcccctccttgatatcacatccactatgaatgtctcacccaggccagtgaacagaccctattgccacattattcatgtttatgtttgctctagggcagtggttatcaagcttgagcacacatcagaatcatctggaagacttattaacacagatttctgggtcccactcccagagtttctgatttagtaggtctgggataggccctacattcccaataatacccaggagatgctgattctgctggctccaggatcacactttgagaacccctgctctaaagcaatgttcacaagtgtatttttagatcaaagacccattggagaatctgtcgaaaagcttttctaccacttcccagtaaataatacacaaatgctaaaaaatcattaaaatttctttacaatttcag

SEQ ID NO: 53533 - DNA, 918 bp, Homo sapiens
aaaccagcctcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggctacatccacgtgacgcagaccttcagcattatggctgttctgtgggccctggtgtccgtgagcttcctggtcctgtcctgcttcccctcactgttccccccaggccacggcccgcttgtctcaaccaccgcagcctttgctgcagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcctacatctgcccgcccttccagcccttccccagcccctcctcttgtttcttcattcattcaacaaaatttggctggaaaaaaaaaaaaaaaaaaaaaaaaaaaaaaaacatattaaaaaacaaaaaaaaacacaaaggggagcgcaaaaaaaaaacacgtg

SEQ ID NO: 53534 - DNA, 842 bp, Homo sapiens
aaaccagcctcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggccacggcccgcttgtctcaaccaccgcagcctttgctgcaggtaaggactctggactggactggggcatcgcgagccagcgaattcctgccgaggagctgagccatctctcttgtccttgtccccagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcctacatctgcccgcccttccagcccttccccagcccctcctcttgtttcttcattcattcaacaaaatttggctggaactggaatctggttattttgagattaa

SEQ ID NO: 53535 - DNA, 756 bp, Homo sapiens
aaaccagcctcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggccacggcccgcttgtctcaaccaccgcagcctttgctgcagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcctacatctgcccgcccttccagcccttccccagcccctcctcttgtttcttcattcattcaacaaaatttggctggaactggaatctggttattttgagattaa

SEQ ID NO: 53536 - DNA, 714 bp, Homo sapiens
aaaccagcctcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcctacatctgcccgcccttccagcccttccccagcccctcctcttgtttcttcattcattcaacaaaatttggctggaactggaatctggttattttgagattaa

SEQ ID NO: 53537 - DNA, 640 bp, Homo sapiens
aaaccagcctcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcctacatctgcccgcccttccagcccttccccagcccctcctcttgtttcttcattcattcaacaaaatttggctggaactggaatctggttattttgagattaa

SEQ ID NO: 53538 - DNA, 325 bp, Homo sapiens
tagcagggttactggccttgctgcggcccaagggaaaactctgcaggccctattacttggcggcctttaactcttatagaattgggagagaacactgacaaaagcgaggacatgattttacggttacaaatgatttttcttgcttgctttcttctcaccctttttaatttttcttttcttcttttcctgtctatcttaccttccctccgtgatccctgccagcccctcctttcttattatagctgatcatggcagtattgtttttttctgggtaaaaatcagagtggattagagaaagcttagcaggcctagcatgaggcctgag

SEQ ID NO: 53539 - DNA, 295 bp, Homo sapiens
aatagggctccctttgattgtcatccttagacaaaatttgatactctttgcactaccatatgattatatcccctgattttctaagattaaagtccattagagttagaaattggaactctcaagccgaagtcaagaaaacaaatcatgtctggttttagaggtgccagaatgatacaatggactttggagacttcggggaaagggtgggaggcgggtgagggataaaatactacaaattggggctgcgcgtggtggcttacgcctgtaatcccagcactttgggaggacaaggtgg

SEQ ID NO: 53540 - DNA, 209 bp, Homo sapiens
  misc_feature (64)..(65): n is a, c, g, or t
  misc_feature (187)..(187): n is a, c, g, or t
  misc_feature (196)..(196): n is a, c, g, or t
tatgcagacaattatgattacatggggtaaaaatactccaagatagtattcagttctcaagatnnttcatcacatttgccaagtttttctaccataaaattccccaccaatccatttatgtatagagttgatagttaacagagatcggaaatggccattgcatctttagtctggatttcctgagacntttggtttntttctagggctgc

SEQ ID NO: 53541 - DNA, 542 bp, Homo sapiens
ttgcgatagtttgctgagaatgatggtttccagcttcatccatgtccctacaaaggacatgaactgaggctttcatttattgtgtttatcactgaaaacaaatacatatttgttgcaaacaaattttgttcacattatacaaaaaggaataaacttggaagcaaatgtagctataatttccttctagatatttttctctagttattcaatgtaacctggggtcatatataacaaaaactaacatctactgagaatttgccaagtgctgtgctctgttccagtacttcacatgtgttagttaatgtaactcttacaaggcaccattcagataattacagccgaggaaactatagaacagagagaagtcttggtgttgtttagtggcaaagacagaccatgagcctacatagttcagacccacagtccattagtctgcaatgcctccctctagtgcttagtaaatgcttgttgaatcaacaaatgtttctcattgttcagaagtttgacatttttataataaaaattgacagtattttctttgt

SEQ ID NO: 53542 - DNA, 456 bp, Homo sapiens
cttagactgctcaagaattaaagcttcaattcgaacaaccaccctaaaactgagttgacatgttaggtatttgtggatcacactacatacaatgaccaaaccagttagtcatatacatatgattgctatttgttaaatcattcatgctcagagtctttgcttaaccagaggctgccccttctggctctgggatgtcctatcatcaccttttctgtagacacgaccctgtcagattttcctcctttagtcctggaaagggagaaaagatttgccaagaagagaagagcctgtttacgtgccctaggtcatccactgcagctaacttttggggtatctgtttgttttgttttttgaggcagggtctcgctctgttgcccaggctggagtgcagtggtgcaatcatgactcactgcagccttaacctcctgggctcaagtgatccttccacctcagcct

SEQ ID NO: 53543 - DNA, 327 bp, Homo sapiens
gacagaaaacaaaatagtgttctagtatctcaaatatttagagcattattttttaataagaccccttattttatctgtcttgttcctattgtttccacaaaacctggataaacctcttagaaaccatttcatccaacccctgtctccaggttaagactttatctattggtccctataggtaaaagaagttgactaaaacataaagcctatagtatctctctttaacatgttatagtctaaaaatgtttctcatctttaatccaagctttccctttcatatacttagcacattttcactttcctcttttttcaatgaagtaagcttct

SEQ ID NO: 53544 - DNA, 772 bp, Homo sapiens
taatactgtattatatttagccaattgtttattaatgtctctgcctcacatcctttcttccatgttaccctttattctgaagtaaatcctttagaagttcttttagcaagtatggtaaatttacatgaaaacttctttattttactattttgaattatagtttaatattgtgaagaattcaactctttgaaaacattacttttctgtctcctggtttctgcattgctttgaaaagtcttttgtcaatataattaacatttattttgttttgtttttattttctcttattggtttgtaagtgtttcctctggttttggtgttctgaagtttcgttgtgatatgcttaggtatgaaatttttaattctgcctgagactcttctataattcctaaatcttaagattcatctctttcataaataatgaaaaattatcacacatgttccctttgaatattatgtctctcaaatttactctattttctcctataggaaccccaaatagctgtgtgttagattgtctattctagacttcgtgcctttttaactgtttttattttacaccttttatttctcagtgcttctttctgaataatttcttcaaataagttttccagtgtaataaatctctctttacctgtgtccaacatatgctctttaatgtatccactgagttttaaatttcaataatggtattttccatgtctagaatttctatttggttctcattaaaacctctctgttctttttccaaaatacaggatttttaaatatg

SEQ ID NO: 53545 - DNA, 228 bp, Homo sapiens
gggccaggtagggcctgagcaccctgttctctgagtcctgctgccccagcagcccaaactcaaactcagctccaaggctacactgagacgtgtcagggacgggtgtatccggggagaagggcgcagtgtcagagcaccctgggaggggcttgtccgagcgaccgagcaggtagggcggggcactggtggctgacagacatgacaggcccagggtagggaggcctgagt

SEQ ID NO: 53546 - DNA, 519 bp, Homo sapiens
tgggctgtgagggcctggaggttggatgctttgcctcatcttctctttagcttgtctctaaaccaggcgcgaggtcagcactcactggatatttggttgggttgcctttgttcctttcactgatgaagggaacagtaagtgagcatcctccttaggtgtcaaagtgtggtgctgggcactagcatgcccacgatcccaccttcaggaggcttcccattcctaacaaggagacacagagtcagctccctgaatcctcacaagagcctccaaaaggtaactactgtgatcttcattctgcagggtaataagtagaggctccagcagtagggaggcttcctccagaccctctcacctactcattaccctcccatttaaataaatagtggggccggatgaggtgctcatgcctgtaatcccagcactttgggaggctgaggcgggtggatcacctgagatcaggagttcaagaccagcctggccacccatggtaaaactcatctctactaaatactaaaaaaa

SEQ ID NO: 53547 - DNA, 1319 bp, Homo sapiens
cccggggcccggcccgttccctctggcctctgatactccgcgctccggagtgtgccgccggatcctcgctccaacctcgtcgcgtcctagccccccgggatagaccgggccggcccacaaacggtgtgcccgcaccccgactcctgctccatgcttttggcagtcatgggagcggggggttgtgtatgggacagtgggcaactcgctgcaaagccaaccgtgtgctcccccgccgcgcccgtgagcttcacgcctcggacagctcctggtgcactttcccgctcttcctgtcaggaggtggtgccctctgggtaccaggccgctcgtcccgggccaatcgcaaagcgcttagagccgaatggggcgggacagaggcaagaaagggtcgtcccaattggagcgttcgaaaggttctgggcagaggcggggaagcggcgagtgggggcctcgccccgcctgcggtcgccatggtaaccgagagggcgcagctcagcgttggcgccagcaccggggtcttgtgctgtccctcaatgggtgaccagttaaggtgggaacctgtggtctcacatacttgaagtctgagctgagtggacctgactgccatagactttccattgaaaggggaaatgtgtcagagagaagcgagtctgggaggagggaaagtgccttcagtccaggactaatttcaaggtttacaacactttacacactctgcaactcctgataatccagggactactcctttggcagcgtttgctattcgatgcctccagatgtactgaagctgcaaaaacgagctcttcattacaaagatacgtttgtttaggaagagactggatttcacttgtcaacttaccccatcaccacgagtcatttaatgttggtaacgccagccacgatttttcgtatctataacaccccttcttccattgaattctacctacaaataactgaaggctcacattattttggaatatggacctccgcctcttgtggagacttgagattgctcttaagctgatttcccaaacaggggctgcaatgtgtgttcccgattttagattcattgagctcaccctagatgagtcctttggttcggtggttcggaaaagtctctttgttccttctccaaactcaatgttccaggatctcttggtgctcgtgccagtgtctcatgtagaatgttgcgtgatctctgctcaagaatctgagtcacaaggttgatgccttcacagatgacagaacagaagttccctgagtacccgagtctgtctttgctgtttctaaggtagtgattattaaaatgtcaagggaaatga

SEQ ID NO: 53548 - DNA, 2176 bp, Homo sapiens
cccggggcccggcccgttccctctggcctctgatactccgcgctccggagtgtgccgccggatcctcgctccaacctcgtcgcgtcctagccccccgggatagaccgggccggcccacaaacggtgtgcccgcaccccgactcctgctccatgcttttggcagtcatgggagcggggggttgtgtatgggacagtgggcaactcgctgcaaagccaaccgtgtgctcccccgccgcgcccgtgagcttcacgcctcggacagctcctggtgcactttcccgctcttcctgtcaggaggtggtgccctctgggtaccaggccgctcgtcccgggccaatcgcaaagcgcttagagccgaatggggcgggacagaggcaagaaagggtcgtcccaattggagcgttcgaaaggttctgggcagaggcggggaagcggcgagtgggggcctcgccccgcctgcggtcgccatggtaaccgagagggcgcagctcagcgttggcgccagcaccggggtcttgtgctgtccctcaatgggtgaccagttaaggtgggaacctgtggtctcacatacttgaagtctgagctgagtggacctgactgccatagactttccattgaaaggggaaatgtgtcagagagaagcgagtctgggaggagggaaagtgccttcagtccaggactaatttcaaggtttacaacactttacacactctgcaactcctgataatccagggactactcctttggcagcgtttgctattcgatgcctccagatgtactgaagctgcaaaaacgagctcttcattacaaagatacgtttgtttaggaagagactggatttcacttgtcaacttaccccatcaccacgagtcatttaatgttggtaacgccagccacgatttttcgtatctataacaccccttcttccattgaattctacctacaaataactgaaggctcacattattttggaatatggacctccgcctcttgtggagacttgagattgctcttaagctgatttcccaaacaggggctgcaatgtgtgttcccgattttagattcattgagctcaccctagatgagtcctttggttcggtggttcggaaaagtctctttgttccttctccaaactcagtaagctgtcttacctgaaaccaaaaataggggtatgaggatatgaaaaatggctcttactctgcagggtttaatgtaggacaagcagttctttaaatgccagatggattcttggaatgaagcaggctactcggttccaggttctttccttcatatgttgtgtgtacttttaaatactccccactgcaaagctaatagctaagcttacagttaggcaagctaaaatccttacaaactgcacagctgctgaggagggagttccaaaaaatccactctgcttacttacctccaaagaagaacccccttcatgttcattaatattctccgctcttctataccccattgatatgtcaagtttccaattcttctttgaagcccccattatgggttacttataatcgtcattgattgggttttttctttattcttaatttgttttttaaagctgtcaccaaattcttaagcatttttgccaaaaggcgcaggagcaagcggtcaacctttcataattctccaacgctgaggatgcaaaaccacagaattctaactgaaagatgccttaaattctaagattccttccagctgtaaaattcaataatcctgtgactcactattaggactcctctctgccctccttctagactcataatcttgactaatcagtcatgaggatgaggctaattagcaatggggatttatggttatttctagcccactccgaacaatgagttatgtaagcaaagcaacatatataaaaatgtaaataggccggtggctcatgcctgtaatctcagaactttgggaggccgaggcaggtggatcacaaggtcaggagttgagaccagcctggccaacatggtgaaaccccatctctactaaaaatacaaaaaattagctgggcttggtggcaggcgcctgtaatcccagctactcaggaggctgaggcaggagaatcacttgtacccaggaggtggaggttgcggtgaactgagattgtgccactcccctccagcctgggcgacagagtgagacttctttt

SEQ ID NO: 53549 - DNA, 389 bp, Homo sapiens
caaaattgctgccataagtgttaatgctatgctacaatctcaaatatataaaatttcttcctgtgatgtctaccagttccaataacattcacatgtaaaaatgcctacaaattgcagggtgctcatagtatgtgtgccttgtgtataaatatgttacttatacatatacccatatacatacacattttaattctaaattaatctaaattaatctctcaagttatagttaagatagaaactaaaagttccacttttagtgaactgaatcgtcatgtcatatctgttaattaagtcctatatctactagttagatgcttgcatttaatatgcaaacatacctactagttatattatatgcatattatattatttgcatattaaatgcaaac

SEQ ID NO: 53550 - DNA, 232 bp, Homo sapiens
cagcttctttctttctttcctcccatttctcctctcttcccctcccttttgcctttgctctgcagagacactggtgccgtgacacacatctgagcatggctggtggggctgaccagtggtcaccagtgcaggatttaagtggttggagcttaatagtagctacaagtctttaatttcttcagcaggtttttaatggcctttgatgcacgttagaaaagacatggaaagtcct

SEQ ID NO: 53551 - DNA, 389 bp, Homo sapiens
acttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaa

SEQ ID NO: 53552 - DNA, 514 bp, Homo sapiens
caagcatggctcactgcagcctcaacctcctggactcaagtgatcctcctgcctcagcctcccatgtagctgggatcacaggcacatgccaccacacctggctaattttttattttttgtagagacaggggcctcacttcattgcccaggcggatctcgaacacctgggctcaagcagtcctgcctcagcctcccaaagttctgggattacaggcataagccactgtgcctggccttgaatatattttttaaccaaagtaatttatgaatataaattgtttctatataacccaaagtcactctcattgacattaagaaactcagagagtgggttctaaatgtaatattaccacacacccaagtcacttagcctctacaagtaccacgtaactagcagccgttaaaagatggccaccgctagtccagtcggccacagacatggttttgtttggccaatacaagtttttgaaagttttaaaaaattgacaacattaaagatcagaaacttgaccta

SEQ ID NO: 53553 - DNA, 190 bp, Homo sapiens
cccgagctctgtggggccccggaaacttccaggaatgcgtggaagaccagcatcatgtcggtgctctcctttccagttttcaaacaggctatattggagactccccactttgcaggaaacaagaatccatcgtcaggccgtgatgtacgggatgtttcttttctctgtggtttcgctctcgttgtctacg

SEQ ID NO: 53554 - DNA, 375 bp, Homo sapiens
aacaagaaactgaaagctgtcaacaaaatgtgtttaaaactttgccctgagtgggcatcagactggctgtttttaagcctgaagtccagccgcattgattaggcacgttggccatcagcatcttccagcagagcagatctgcagagaaaggcaggacccaggttttagtgctgattctggatggcccttgaatatagacagaatatagacagcttataacaaagccattccaaggcagttttattttacaaatctaaaactttcggtagttcttttgaactaccgtgtttctgtaaatttcttcagtgaactctatgaaccgttttttttgtttttgtttttgtttttaaatagcagcggttcagctgttgggaa

SEQ ID NO: 53555 - DNA, 115 bp, Homo sapiens
ccaatgccaagtgagaacctgatctactctaccagagagactaagtggaggagaacccagctgatagcaccagtgaactgccagatatttgagtgatgtcactttggactatgta

SEQ ID NO: 53556 - DNA, 360 bp, Homo sapiens
atataatacacagattgccctcaaagtcatatttccaactgctcatcaatctaaaaatccaaaattttgaataattttttgatgaaataatttatttcattgtttctcaattttggctgcacagtggaaccacctgggctgtttgaaaaaacctaggcctagccaggcacggtggctcatgcctgtaatcccagcacttagggagaccagcctggccaacatggtgaaaccctgtctctgctaaaaatacaaaatcacctgggcgtagttgtgcattcctgtaatcccagccacgccagaagctgaggcagaatcgttcgaatccaggaagtggaggctgcagtgagttgagatcttgcc

SEQ ID NO: 53557 - DNA, 327 bp, Homo sapiens
ctgtctcagcctcctgagtagctgggactacaggctcacgccaccacaccccgctaatttttgtatttatggttgagatggggtttcaccatgttggtcaggctggtctcgaactcctgacctcaggtgatccacatgcctcggcctcccaaagtgttgggattataggcgtgagccactgtgcctggcccaaccacaaatgtttctgacgatgtcattccgtgtccaaaatcctttgctatcttcccatcaagtccaggcctttttcctctttttccctttagcttggacttcgttcaccgttctcctcctggcccctccctcctt

SEQ ID NO: 53558 - DNA, 340 bp, Homo sapiens
cagagatggggtttcgccttgctgcccaggctggtcctgaactcctgagctcaggtgatccacccacctcggcctcccatagtgctgggattacaggtacgagccaccacgccttgccatgagcagcctcttctgatatccgtggtgtgttctgtacactttttttttgtctgaatgcacctttcctttctcctcccttgcactccagaaccgtggatactcaagtctatcctgaaccatatagagggggagctttgagtgctatatgaaattcatttatgatatcattcttcattccttcacagaagtaactcagagttcaattagggattcacatggt

SEQ ID NO: 53559 - DNA, 667 bp, Homo sapiens
gtctcctctggacactgtgggtcaaaccttttgagagacaacaacaacctctgaaaccctcttgccatgacagcaagcaaggaggagggaccagaagaccctcgacgccccttttcagcaggaagtagctacagaagaatgacctccaccctatttcccaaaagatttctgggtcccaactccttaaggaataaacgtgaaagggggcagttagtcagatattagcaggcaggaggggaggtacccatgttggaaggaacagcccagaccacctcttaagatgcccagtactcactttatggtcaaactcaaaatgtggctaactagatcctgataagggagaaaaaaggcaaaagcagaattcttgagagccacacaggtgcaatgagtacaaatttgatggctatatgaccttcccgggtggcagtaatgagcaacgtccccatcgggtggaatttgtattgatcactgcgtccagtgcatgtacatgaaccacagtaagggatgatccccccaagccttggtgagaactggacaaggaaagaagcaagaccatagaatatcgaatgcagaatgtcccggggctgtttccagcagggtcagcccactcctctgttggagtgtacttttacttccccaataaaacttttgcctgctttactaaaag

SEQ ID NO: 53560 - DNA, 433 bp, Homo sapiens
gcagtcaggatggacacattagaaagaaacattttagtttcaatgttaccataaaaccagaacgaaaagcagcatgctgtattatattttacaatttaggttccatttctaactccacctaaaatgaatatgaacaaactcatttttaagtgtttgtcagtcaaatacaataatagtctaagtttattcacatatgtaccaaccaaagcccaataaagctaaaaggaagccaagtgtaataaaaaggcagctataaggtcttgtgtttgaatttttacccagcaagaaataaatgatacttagtaatccatctttcccccccactgccatccctgcacacatctaaaataggctaacttcacctattctaacttctgaaattgttttggaattcctgttttaattttttttttttaagactggatggttaagt

SEQ ID NO: 53561 - DNA, 229 bp, Homo sapiens
ttgattttaatataatttttctttatattataactgacatcaaatatcagaaaaaataaactttaaatatttctccaaagtttctgcataaattcttaacatgaaaattaaaatgtagtatgtatttgtactcaacattttatatccacaactctctgtattttaatgctaaaataagccatcaatacaattatagcattctttaaaatttttttacataaatagcaaa

SEQ ID NO: 53562 - DNA, 517 bp, Homo sapiens
gggaaggaggactgattctaaggggacacacagtgatgtctcaagatatttttggttgtcacgacttgggggtgctcctggcccggagtgggtggaggccaggggcgctgctcagcaccccgcagtgcccaggacggccccaccacggagaacaatccagccccagatgtcaacagtgccgacggagggggagaaatcccgctccagtgtgatctccaagcaatgaaaaacacagcacacaggattctgtggcatatgctatcacagggtacgtgtttttaaaggaaaggcacacacgtatcttaggaaagggacatacggagtcgatgacagtcgcttgtctctggggagaagggctggctgcccgaggagcagagaggggaaactgacttcttcctctaccttttcaactttgtaccttgcccatccagaggattttgaacgtaactgctctagacgcaacttttccctggctctgggttatctggcaagagtcctgtgtcgacagcctcgggac

SEQ ID NO: 53563 - DNA, 258 bp, Homo sapiens
aagtaggaagctaaattaaagtcatcatctcttcttcacttgttcctcagtgtagctaagaagacttgacttctgggactttagctctgatagaggagtttagatacgtgtctcacctcctgaactttctgccttcatccccttttcattctcataatctgtcatgaccagaaagaggggacgccttttctgggctgatgtggaactacatggcctcttattctcctctttttggattggtattgcaataaggtaaaa

SEQ ID NO: 53564 - DNA, 602 bp, Homo sapiens
tgagttttcatccattggtgacaagatggtcagacttctagagaaataaggtagttttgtggtagaacaaactcttccttgtgggaggtatagtgggatttggggaatagggtttatgaaatggtccccagagtgggatggcttgccttttcaaactgggtttcccacccagcaagttaagttgacccattgcagtggattgagtggagggcaggtgaagggcaggtgttttcaagtcaaaggagttcaggtgaagggcaggtgcttttagtcaaaggagttccttagcattatttcctcctttatttggagatcagattgaagatgtaggggactagaatgcagttgtagtttgtggtgtttactttttatggaaaagtgcctcttatgtgaaaagtcttctgtgcttgatcctgggggtaggggggttataaaaatgtcatacctgggatcctgcccttaaggagttgatggtaggtaatgctttcctttggctttttgttcatcttgagtctgtgtatgttcagttatcttcagccatttcctgggcaatgggaaacatttctgttaaaacaaacttctgactttgatctgtgacttat

SEQ ID NO: 53565 - DNA, 397 bp, Homo sapiens
gagacggagtctcgctctgtcgccaggctggagtgcagtggcacgatcttggttcactgcaagcttcacctcccaggttcacaccattctcctgcctcagcctcctgagtagctgggactacaggcgcccaccaccacgcccagctaattttttatatttttagtagagacgggggtttcaccgtgttagccaggatggtctcgatttcctgacctcgtgatccgcccgccttggtgtcccaaagtgctgggattacaggcgtgagccaccatgcccagcctttggagacacttttgattgccacaactcagggtagggagggctgggaaatattactggtgtgtagtgcatcgaggccagggatgctgctagacatcctgcaatgcacaggacagg

SEQ ID NO: 53566 - DNA, 350 bp, Homo sapiens
aaaagttgaggtttctggatacacactgtcaagtcactgcccaaggaggtcttggaagtttacagtctcattaacagggtttgagaatgaccattttctgacaggatttccaactctgaggattctttatttccccatttgctgttgactctaaagatgagagggtgagtgacgaatataaatatgggagaaaaataaaacgatgtgtttctgctttcgattggagagctccccagagccgtctttggaattgctgttccctgaggggatatggtagccagagcatgttggcccagctgatgttttctaggattggtctttgagtgtggcatttgctgtctctgtgtccc

SEQ ID NO: 53567 - DNA, 145 bp, Homo sapiens
gatttgccgggctgtgtgtgctctgtttggaggaagagactggcggtacattggccctgatcaacaaggaacttaagtttccttgaaggagatcagagctcgcatgctggctggctgacggcaacacaccctgtggctttgtgag

SEQ ID NO: 53568 - DNA, 232 bp, Homo sapiens
gtttattaattccattatgagtaaaataaggggtaataatatacctgcctcatacagtcactgtgaagatcaccaaggttaatagatgtaaagcagttagcagtgtctggtacacagtaagacccaatacacatgagtagaataaacacattcgttgagagaagagggagcagcaagggaagtgacagcaacgctcttatagcaggagttaatgtgaagagacgagctatag

SEQ ID NO: 53569 - DNA, 249 bp, Homo sapiens
tttacaggttattgatcagaattgtcccatggtcatccttagctgaaagtgagcctggatcatcaaggctttcagtggcacacacatcttcctgaaatgtatccttttgtctcatccatcacaacttcccagggctcttttcctttctccaaagaggaaactacatctggcagaagatgaaaagcccagtgagatcatgctgtagtcctctaaaatcacatctatgcacaaatcattctgtgcaggatc

SEQ ID NO: 53570 - DNA, 198 bp, Homo sapiens
caacagtaaagactcacatgccaccacttgaaagacatggctgaaatagtcctttgatggaaatgtaagataaaatgaccaggacacagagagtttgaaaatgaataagctaaatattcaatccaaaaagttcgaaatgcaacagagaaaatccaaagaaaccaattgaaagcaacaagaaaggaggaattaataaca

SEQ ID NO: 53571 - DNA, 611 bp, Homo sapiens
gtcacacaaaataagaagtataaaagaagcataaaataaagttaaaaatgaaatgaaacactaataaatgaaaaaacaaacattgcggaggatcaaaacacatgaaaaacaggttatttgaaaatacttctgcaagatggctcaagaaaaggagaaaaggcacaactgaaaaacagtaatatggatatacaggctgggcgcggtggctcacgtttgtaatcccagcactttacaaggctgcggcaggcggatcacttgaggccaggagttcgagaccagcctagccaacaaggtgaaacccgtctctactaaaaacataaaaacacaaaaattagccaggcgtggtggtacacgcctgtaatcccaactacttgggagactgaggcacaagaattgcttgagcctgggagacggacattgcagtgagctgagattgtgccactgcactccagcctggatgaaagagcaagactctgtctcaaataataagtaaataaatagtaaatataaacaaaaataaaaatgggtataggccgagtgcagtgactcacttctgcatactcagcactttgggaggccaggagtttgagaccagcctgggaaacacagca

SEQ ID NO: 53572 - DNA, 271 bp, Homo sapiens
gcatgccaccgcgcccgactaatttttatatttttagtagagacggggtttcacctcattggccaggctggtgtcgaacttctgacctcatgatccgcttgccttggcctcccaaggtgccgtgattgcaggcgtgagcactgcacccggccgctaaatctcattttgagtctgagttaagcagtttaccttttttctgatctttatttgaaaaaaaaattaatcagcatgtccatatgctagctgtctaaagaaaatattgatttttttg

SEQ ID NO: 53573 - DNA, 270 bp, Homo sapiens
gctggtctcaaactcctgacctcatgatccacccgcctcagcctcacaaattgctgggattacagctgtaagccaccgtgcccggcccaaaattcattcttttacatgcacaaggaaggaacatttatcatatgtgaacacttaacatatgactgagccataaaaaaggccttaacaaatttccaaagatttaaatttcttagcatggaaatggatattgaccaatacagattaagccagaaatcatacaaaataaaaatagcttacaaa

SEQ ID NO: 53574 - DNA, 388 bp, Homo sapiens
ctgggttccccaggttgcttttgaattcctgcccttagacgatccttgcacttggcctcccaaaagtgttggcattacagacatgagcttccgtgcccaacctgttttctacttttaaataacatttctgtgtttatagaacttcagcaatctcgctcccattttacctaagtaaaactcaaattctcaacatttgcttatacagtgtatgttttcattatgacattcttactaggaacaaaattgagatagcacattaactgggttgagcgaggtggcttacatctataatcccaacactttaggaggctgaggtaggaggatgcttgagcccaggagatcaaggcttcagtgagccatgattgcaccactgcactccagcctgggc

SEQ ID NO: 53575 - DNA, 602 bp, Homo sapiens
taaaaaaatacacattcctagtagacatttcttattgacagtgtacggtattctgtgagctggggaagacagatacccttttattgggggcagggggaggatgtagcaaaggaccaattttcctggagatcctattacgtgaagggacttatactggacacatcatggagaaaatcagaaagaaggctgcttaataagacccactcctggatgcggccactctcaattctcagtgtctttgggaagcaaggttcgccatccacttgtctaaacagatgatgatagcagaggtgctgcacaccttctccctgtgacttgtgaatgcctttcgtgctcccaaataaggaactcctctcactgctgtctgctctgagctgtatttcattttgatagccatttgcaggggacacctttgaactccatgcaatgtaaaagatgtggttgagaaattcttcaatggaatttcttccccttttcccccaccctcattttcctctgggtgatttacagcttgaacattaggtacttagagacagtatgtctgacctacctttaaaaatacacattaagacacacacaatttgaagaaaaaagaagccaaa

SEQ ID NO: 53576 - DNA, 2873 bp, Homo sapiens
aatagcaatagctttatagcagctccggttacctgttttaaacatggaaggagagtcgctcccagatagccctcacgagtggccctggagcagggagtggtggagcagatcttccttgtttgggaggagcctgaggtggacctcgcgtcctgagtctggaaggcacctatggggacctgctggggtgatatctcagaaaatgtgagagtagaagttcccaatacagactgcagcctacctaccaaagtcttctggattgctggaattgtaaaattagcaggttacaatgcccttttaagatatgaaggatttgaaaatgactctggtctggacttctggtgcaatatatgtggttctgatatccatccagttggttggtgtgcagccagcggaaaacctcttgttcctcctagaactattcagcataaatatacaaactggaaagcttttctagtgaaacgacttactggtgccaaaacactgcctcctgatttctcccaaaaggtttcagagagtatgcagtatcctttcaaaccttgcatgagagtagaagtggttgacaagaggcatttgtgtcgaacacgagtagcagtggtggaaagtgtaattggaggaagattaagactagtgtatgaagaaagcgaagatagaacagatgacttctggtgccatatgcacagcccattaatacatcatattggttggtctcgaagcataggtcatcgattcaaaagatctgatattacaaagaaacaggatggacattttgatacaccaccacatttatttgctaaggtaaaagaagtagaccagagtggggaatggttcaaggaaggaatgaaattggaagctatagacccattaaatctttctacaatatgtgtcgcaaccattagaaaggtgctagctgacggattcctgatgattgggatcgatggctcagaagcagcagacggatctgactggttctgttaccatgcaacctctccttctattttccctgtcggtttctgtgaaattaacatgattgaacttactccacccagaggttacacaaaacttccttttaaatggtttgactacctcagggaaactggctccattgcagcaccagtaaaactatttaataaggatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtgtaagttggtatacagaaaaggtgtccttttgtaaaaatcagcaattctccagaggactatctcacataagtcatcttatgagctcacaggacaagaatatacctatgtctgattggttgccaggtaagacattaagactcaacaacaatatcacagaatcagaccatgtgtcccatggcaatgtgaatccaatagtcaattacataatgactatagaaacacaacagtcaccaaattaaactagacttactattttagtgagttaaaaattacatactaaaagtttattggtaggtaataaatgcttttgagtaaatagtggaaaatgtctcatgttgaggctatggttttgtaggaacaagtacccttattttcagagcatcatgtacttaagtataatggtcttggtaaagatagttcatataagttgtatctagacaactgtatcgtctaaattgtaaacaattatctagtaccaattttccctttttatttttcagcatcaagagaaaaccaatcagcttcatcaaaacagaagaaaaaggctaagtcccagcaatacaaaggacataagaaaagtgggtcaccacgtggtgttcacatacattttctaattgttaactaattggagtcacagtattcttggacagaaaatgatatatcttgtgagaactgatgattgtgcattatgtattatgcttaaaggtgcagtatgccataaaaggcaaacccttgcaataatgagaaacactgatattttactaacaggagaaatgattaccacagtatttaaagtatacgtggtaaagaatagagtctgtgaatgattcttgaaataatatgtaaaacctactgaaagttaatcctttttaaaaactttatttaaaaagaaaaattagcagccaggtgcagtggctcacgcctgtagtcccggcactttgggaggccgaggctggcagatcacaaggtcaggagatcgagaccatcctggctaacacggtgaaaccctgtctccaccaaaaatacaaaaaatctgccgggcgtggtggcacacgcctgaagtcccagctactcaggaggctgaggcaagagaatcacttgaacccaggaggcagaggttgcagtgagccaagatcacgcccctgcattccagctgggcaacacagcaagactctgtctcaaaaaaaaaaaaaaaaaattagcagatgcttgatgcttacagtagatgtgaagcctaataaacccatttttcctagaaagcaaaactttctagagtgatactggtaagaaatccaagttgatggcaaacaagctttaccaaatttttctagaaatgctttctatactaaaaaattagccgggtgtggtggtgcacgcctgtaatcccagctacttgggaggctgaggcaggagaattgcttgaacccaggaggcggaggttgaggtgagccgagatcgtgccattgcactctagcctgggcaacaagagcaaaactccatctcgaa

SEQ ID NO: 53577 - DNA, 634 bp, Homo sapiens
cctgagtgacagagcgagaccttgtctcaaaaagggagagttgggtacttgttacaacagtctctgaggcgtgaagaaatgaacaagaggacccttaatgtggaccagccttagcatctgccatagaggagtatggttatctgtagcataaaagagatcaagttggagcttgaagaaggtagagaccgtttgtaaaaactctgtatgtgataaatcagaaagaaagaagtcaaagtgttaccaagtaggatttggagcctagctgaaactagataggtaaatagtaagcactcagcccagtttcatgatgccgtgacagcaggcagctatagctatggtcaaacgcactgcttttcccagacctctgaggtcagttataggtaatcctgcttttgtttctggaacacactagaatttacatagatttttttcattagaacttctgttatttaacataactcaatagagaagcatgtttcactttgaagagacctttatataatagattttcctttcttttagaatgtcaaagtattatttttataatagtggtatctaatttcaagtacttagaattctcttcattgaaaaggtgctagctgacggattcctgatgattgggatcgatggctca

SEQ ID NO: 53578 - DNA, 447 bp, Homo sapiens
tggcatgcacctgtagtcccagatgctcgggaggctgaggcaggagaatcacttgaacctgggaagcagaagttccagtgagccaagatcatgccactgcactccagcctaggtgtcagagggagactcagtctcaaaaacataaagaaactcctgtttgtttgcaaatatgatataagccaaagctcatgctatttagagaagttatttgatctttacataaagaaaacgttctttaaatgggataaattaattttatgtcctttcacacattttaacaatgataaccttcttataaataaaagatttgagaattataatacatctaaatttgtttcattttagcagtctccatggaaggtttcagctggggtaactacatcaatagcaatagctttatagcagctccggttacctgttttaaacatgtaagtacagaatttctca

SEQ ID NO: 53579 - DNA, 288 bp, Homo sapiens
cttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtga

SEQ ID NO: 53580 - DNA, 409 bp, Homo sapiens
ggtggcttccccagggcctatgcctacccttgtccaggtcagcctcatgctgagcccccagggtccctgagcctttctgtccacgtcccatgcccttcctcccttccccagccttcacgcacacagtgagaatttctggagcacctactgcagactcacaaacagcagtgcctgcggtgagcaggtctatgcaaacctacccccaaaggctgagggaaaaaagctaacagatccagtttctcagaaggaaacacttaacagggactcataaacagaagccatgtctcagggccgggtgcggtggctcacgcctgtaattccagcacttggggaggctgaggtgggcggatcacttgaggtcaggagttcgagaccagcctggccaacatggtgaaaccccgtctctact

SEQ ID NO: 53581 - DNA, 343 bp, Homo sapiens
aaaaatacaaaaattagccaggcgtggtggtgcctgcctgtaatcccagttacttggatactgacatgggagaatagcttgaacccaggaggtggaggttgcagtgagccgagaccacaccactgcataccagcctgggggacagagcaagattctgtctcaaatatatgtgtgtgtgcgtgtgtgtaagtattaggagatacgataaggaaatttccccaagtaaaggaagaactgaatccgcaaaaagaaaagagagtgggttgtatggaaacccagtagggggacccattgggaaaaattggtccaaaataatagacaccccaaaaaaaataccctggtg

SEQ ID NO: 53582 - DNA, 283 bp, Homo sapiens
taatgttatttgaaagtaggcttaggtaatttgaacaggtatattgcagactctagggcaacaagtaaaaacatttgtttaaaaataagcataattggtatgctaatagacatcataggaatgggctggaggagaagaagtagcaagtaccttacaggccttggtaagacacatacactatgagtgttaggagaaaaaaaacataaatactcaaggtcctgcactaacagtaaaacttttaggttcccagtggactttgtcatgccagaagaactccttcaga

SEQ ID NO: 53583 - DNA, 278 bp, Homo sapiens
cagctaaagggtaggttggatctggcatcagtcaagaaggctaggggccaggtgtgatggctcatgcctgtaattccagcaccttgggaggccaaggtgggaggattacttgagcctgggagatagaagctgcagtaagccgtgatcccacacaccactgcactccagcctgggtgagagcaagaccctgtcttaaaaaacaaacaaacagaaaaacagctgagaacctcctggaggccacagccagtccctcccctgtgcccggccccgcaccagct

SEQ ID NO: 53584 - DNA, 248 bp, Homo sapiens
  misc_feature (8)..(8): n is a, c, g, or t
  misc_feature (12)..(13): n is a, c, g, or t
  misc_feature (69)..(69): n is a, c, g, or t
  misc_feature (73)..(73): n is a, c, g, or t
  misc_feature (101)..(101): n is a, c, g, or t
ttaaaccntaannacatatgggaaaaaaatctgtagtctcatatctgaaatatttttaaatcaagattntcanatatcacaatataggaaataatattttnctaaggaacttatgttcttgttacatagatattactgtaataaatgtcatgaattttcttcatgatgtgacccaagtccacctttttattgctaaatcaagtaaaatttaaaaagaaaactgtcacctagattttcaaaacagcctc

SEQ ID NO: 53585 - DNA, 443 bp, Homo sapiens
atgtctcagtcacagcaccgctgacagcgaagaacaccaagagccagcgtggggccgaacacaaggtcagtcctccatcggtggcgtgatgacaaccaccgcctcagccaaggctgttattaccactcccatccaaactaagcgtgtttcccccaggccggtagaaatggcaggtgctgatacctttcagctctcagtcgggtcctgggctgaatgctttacttgcattatctcatttcgaccccccaccccggcacggggagtcattagcatcaccattttgcagatgaagagactgaggcttggagaggttagggaacatatccagggtcacccagttaacaatgttcatttaattcattttacactcatttcacagcttgtgtctgctggccactaggcacaagacggtgcataagacacacttagtccctgtgaagctg

SEQ ID NO: 53586 - DNA, 753 bp, Homo sapiens
cagctgtgggggcaggatcaggcatgtactccttggtggccccagcgctggctctgcacccgatgcatagtaggtgcctagcaagtgcatctggaggctcgttcgatggccctgcagggctctctgggtctggcgggagacattgggagtcaaggtcagtgcctcacaccatctcctcggcagcatgtgtctttctaccgtttgccgtggcccttcccatggccagtgactaacagctttcacgcacactctggggtgggctgaaaggccccggaagcagccctctttccctggaagatgggagatgaatgacagcaccctagcttcctgccttctctggggacgccctgagcacggtccgttctgtctcccaggtggccccagcaggactgagagcagcagcagtccacagccatgacaactcaaccacctgccctgtgtcagctgctgtcccctcctttattcctccccactccccttctgcagcatcctggagtcacttcccgaataaacccctcacatcacctccttgtctcagggtttgcttctggggggacccagcctgagacgggatgaacattcattcgacaaaatattgcggctgggcgcagtggctcacgcctgtaatcctagcactttgagaggccgaggcgggcggatcacttaagttcaggggttcgagaccagcctggtcaacatggtgaaaccctgtttctactaaaaatacaaaaattagctgggcgtggtggtgca

SEQ ID NO: 53587 - DNA, 284 bp, Homo sapiens
aggttccttatcccagttaagtctcaatattttcacacgtaaattttaagtataatatgagttattgggaaacatgttaccttattctgataagtttaaattacgggcctattaagcactattttgttttaagagcaataaaaataatagaaaaaaaaaagaacataatccctaatcacaacaggaaagtattttaatatttagatatgaagcatgatatatacatttatatacagcaatgattccagaaagacctagtgtgtaatactcttaccatttttctg

SEQ ID NO: 53588 - DNA, 425 bp, Homo sapiens
ctgtcgcccagactcccaggctacggtgcaatggcacaatctcggttcactgcaacctccgcctctcaggttcaagtgattctcctgcctcagccccccgagtagctgggattacaggcgcttgccaccatgcctggctattttttgtatttttagtagagatggggtttcgccatgttggccaggctggtcttgaactcctgatctcatgatccacctgccccggcctcccaaagtgctgggattacaggcgtgagtcaccacgcctggccctgagtcaccatgcctggccctgagtgtccttttaatacactggtttgggggtttttttttagagtttgggtcttgctctgtcacccaggatggatggagtgcagtgatgcaatcatggctcactgaagcctcgaactcttaggctcaagcgt

SEQ ID NO: 53589 - DNA, 816 bp, Homo sapiens
atgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgagactctgaggattcctgttcctgtacataaaaatcaccaactgtgcactgaagaaatctttcagggaataggcacactggagagtcaaactgtgcaagggggtactgtggaaagactattcaaaaacttgtccttaataaagaaatacattgacggccaaaaaaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcaatataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttc

SEQ ID NO: 53590 - DNA, 1600 bp, Homo sapiens
gcagaggcgcggcaggggggcgggagccgcggaacccctaccccaggtctgcgcaggtgaggagggggcggggcaggaccgacctcccttgccatgataaccaccttcgcagccggctcccagaccgttggcaccgattgcctagaaaatagggggtctcaggagctccgttttagcgtttatatatcccaattccaattaagccacttccagtattttttggccattgtcagtgtacaagtcttcctcctcttcgagaccatgttattgcaatagcagcaaacgtgttgggaggcctcacaattcatcatggtttttctggcctctggcagatagctccttcctagcgagctgtggagctcaaagtcttttggacacttgattctattcaatccagtatcagaccaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttg

SEQ ID NO: 53591 - DNA, 2253 bp, Homo sapiens
tacttgaattaataaaagggcaggttttaagcctcatgtatctgcgcaggtgactccttctgtgaccccgaataaacctgttccggtcccgttccggggaaacagccttgccttcccctgcccccagaaagttaccctcgccctccgagccacaactccccacgccgccaactcggtctttacatcattttcgacgccccctaagtccctcccgagaggcgcaggcgcacatcgccccttctagcgaactacatctcccacaatcccaatcggccggaccacctccgctcggggcggggacggaggtggagctggtggtccccggtcgggacgaaggctcccgaggtgccctgcctgggtcctccggggtaaagttcgtttggcggaagattgtccgttttcctggtaaggtcacctgtcccaatcaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttgatgtttactatcataaatcattcttagttccactgacactttacatggaaaatgagatttattgctataatacaagaatttaagaattgtgccattgtacttatcacaaaactaatcacatagccaatgatgtgtgagtgagaaacctatcaggtttgtcctgaggatatagcaagaaaagaaaataactgaaactcctttttttttgagacggcgtctcgctctgtcacccaggctggagtgcaatggcgcgatctgggctcactgcaacctctgcttcccaggttcaagtgattatcctgcctcagactcccgaatagctgggattataggcacacaccaccatacccggctatttttgtattttgttttctttttttttgagacagagtctcactccagcctgggtgacagagcaagactccgtcttaaaaaaaaaaaaaaagtgggaattagacgtaagaggcttaactgcattacagcaacatagatgaacaaaaccattttccatattggtcaatgagaaggtaaggttaccagaaaatgtcagtaaatttttaatttcagcacagtgcactttatgtttgtaaatgttgtctatgttaataaagttactataataattaattcaat

SEQ ID NO: 53592 - DNA, 2153 bp, Homo sapiens
tacttgaattaataaaagggcaggttttaagcctcatgtatctgcgcaggtgactccttctgtgaccccgaataaacctgttccggtcccgttccggggaaacagccttgccttcccctgcccccagaaagttaccctcgccctccgagccacaactccccacgccgccaactcggtctttacatcattttcgacgccccctaagtccctcccgagaggcgcaggcgcacatcgccccttctagcgaactacatctcccacaatcccaatcggccggaccacctccgctcggggcggggacggaggtggagctggtggtccccggtcgggacgaaggctcccgaggtgccctgcctgggtcctccggggtaaagttcgtttggcggaagattgtccgttttcctggtaaggtcacctgtcccaatcaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttgatgtttactatcataaatcattcttagttccactgacactttacatggaaaatgagatttattgctataatacaagaatttaagaattgtgccattgtacttatcacaaaactaatcacatagccaatgatgtgtgagtgagaaacctatcaggtttgtcctgaggatatagcaagaaaagaaaataactgaaactcctttttttttgagacggcgtctcgctctgtcacccaggctggagtgcaatggcgcgatctgggctcactgcaacctctgcttcccaggttcaagtgattatccagcctgggtgacagagcaagactccgtcttaaaaaaaaaaaaaaagtgggaattagacgtaagaggcttaactgcattacagcaacatagatgaacaaaaccattttccatattggtcaatgagaaggtaaggttaccagaaaatgtcagtaaatttttaatttcagcacagtgcactttatgtttgtaaatgttgtctatgttaataaagttactataataattaattcaat

SEQ ID NO: 53593 - DNA, 167 bp, Homo sapiens
gggcagcgatatggggacactgagggaggaacagatttggggagggattgaattaagagttctcttatagctatgtgaagtttgagatgcctattagatatcaaagcagacatggctagtaaacagctagatagttccaggaagagttagagttggagatagaaatt

SEQ ID NO: 53594 - DNA, 403 bp, Homo sapiens
gtggctcatgcctgtaatcccagcactttgggaggccgaggcgggcagatcacaaggtcaggagatggagaccatcctggctaacacggtgaaaccccgtctctactaaaaacacaaaaaattagctgggcgcggtggcgggcgcctgtagtccaagctactcaggaggctgaggcaggagaatggcgtgaacccaggaggcggagcttgcagtgagccgagatagcactactgcactccagcctgggagacaggcgagactctgtctcaaaaaaacaaaaacaaaaacaaaaaaaaaaccatatatatatatatatatataaaatcagttgtaacatacatgaactaattgaatttttgaacaatgacttggtatttggtgatattagggcctaatcatttt

SEQ ID NO: 53595 - DNA, 713 bp, Homo sapiens
ttttataatttattcctttatgatgaatgaatatttacaaatgatcataatgtgactggctgtgttgtagaatatgaggatacaattctcaaggaggcagcctgctgtcagagagcttacagtcaacttctgggagaaagaaaacacatttaaaacaaaaaaaattcatatggatgtgatggagagaatgtatgcgagcgagggcagggtatgaggcagttactttgggtaaatataatttatatcaaggtctaaaagatgagaagagaaagagccctagacttgaacatgtgggaaaacatttggattttgccacagcttagcctgagcaagtcatttatccttttttggtttgtgtttctcatctgtaaaatggagcttctaatagcagctccccactacgactagtttacaaggttgttgctgagcaaacggcaggatgccatcaagtacttcctgtaaggagtgtgccgaggtggctgtggttgccctatgtgcatcacctcaaccccatcacattaaattttctcctgcctcttgcatcttttctctgtaatctacatctgaaggcaaagctggaggagagacagaggtcgaactacctgttgctatgctgtaagacttaaaatgttgatattggttttcgaaatacaaatatcaattctccctcttctacacacactgactcctcacccttatgcatgagagtttcg

SEQ ID NO: 53596 - DNA, 352 bp, Homo sapiens
aaaactcctgtctgaaaaacaaaaatgaagtattttaataacatgttctctgttcctatcacaatgattaagaaacacagttttaaaaaattgtttaaaggcatctgtcaaagaatatttcggtaaacatctggtcagtcagcgacccagggcattcagaactaggggtcagtgtcacaactactggcagcatagttgaattttgcagacttatgttagtcattgtaattttaaatatcacatattaggttcacctggattcccaactctgctggtcctaatttgactgccaacagtcatttatcaattgtaagagtggaggaagtctaccaacttagatttctagctgaga

SEQ ID NO: 53597 - DNA, 627 bp, Homo sapiens
gtatcttgaggtagggagatgggtgggtgagaacctcaggtttaatttggaaatagaagagagggatctgccctaacgctttaaactaggtgcagattgggaatttatcctgtatgtatgtcataaaggtataaaggtccaactctgccatttgtttaaaagaaaaacaaacttgatagaatcttgacagatttttaacaattttaaattatttaaaaagttgttataaatcagactgttttttaaaatagcagtaaacatttggggcttttttgttcagatatgtactcatgttaaaatgagtatccatattggcagctagtaatagaggaaaaagtgtatactctcctaatacattaaatgctggcactatatatgaaactgaaagtaaataatattatttaaatcagtgtgctatacttttaatgtggatatggaaaaaaggctcattttaaaaactgcaagaataaatatattttaaatgctgacatgttaggtttttattttttgttttattttgaaaatatgtatacactaaattaggtttttgattaatggttaagaatagtgaataaacaaacatggatttaaaaattaaattgaattaggaattataagactttgata

SEQ ID NO: 53598 - DNA, 271 bp, Homo sapiens
ctgccatggccctgagggcacacttagtactcctgattccaagtgaagaatgcagtgtgcctgcctgccctctggactgagagctcctcaaagacagagataattttctcatttctttattgcactagctaactagtgcaatgcctggtacacctagtgaccgctctgtgtatgtttatttaacaatagtttttatttattgagggctccttatgtgcttggcactttatatttagaaacttttaattctaactctaacctattacatagg

SEQ ID NO: 53599 - DNA, 4253 bp, Homo sapiens
agcggacttccggggcggaggaggctgagtggtgcagtgagggacaaacaaaaggaggcgccggagcagcgctgcggccggcggcgggacggagcggccggggcctggggctgcctgccgggcggccgggcgcggcgagcccaggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccttgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 53600 - DNA, 1607 bp, Homo sapiens
  misc_feature (2)..(2): n is a, c, g, or t
  misc_feature (5)..(8): n is a, c, g, or t
gncannnngcctgcctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgc

SEQ ID NO: 53601 - DNA, 4360 bp, Homo sapiens
agcggacttccggggcggaggaggctgagtggtgcagtgagggacaaacaaaaggaggcgccggagcagcgctgcggccggcggcgggacggagcggccggggcctggggctgcctgccgggcggccgggcgcggcgagcccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccttgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 53602 - DNA, 4614 bp, Homo sapiens
tagatcagtccaggtgtctttgtctacccccgccctcctccttcctgggtaactcctgctgatcctttggctctctctggtggctgggccactctcccagctcctggctccccgaaacccgtgtcgtagtgatcacagctttccctaccctgccactcccatgcacagttctgcacagtgtctggcgcatatggagtagatgctcaccagaggctggttgactgtcggagatgatgggtggatttggtgtttaagttggagtctgggcactggctggtctctgcctgacccagccaccccactgtggctcatctcttgccacttcccctctctggctctggatctcgccatgccgagcccgcaagccttctccagatgccatgtactctctcctccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccttgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 53603 - DNA, 4730 bp, Homo sapiens
  misc_feature (2)..(2): n is a, c, g, or t
  misc_feature (5)..(8): n is a, c, g, or t
gncannnngcctgcctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccaggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccttgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 53604 - DNA, 4634 bp, Homo sapiens
ggatgcgttaattcccttccataatcctcccaggaccgagagggtttcagatcggtgctgggaggggcccagatagttctccccaggacctcttccacctttggaatgcccattacctggagaaggggggtgccgcacatcccccagaccaaccctgcatcccattctatccagattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccaggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccttgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 53605 - DNA, 4355 bp, Homo sapiens
agcggacttccggggcggaggaggctgagtggtgcagtgagggacaaacaaaaggaggcgccggagcagcgctgcggccggcggcgggacggagcggccggggcctggggctgcctgccgggcggccgggcgcggcgagcccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccttgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcgtcccgatacttggggtcctctaaggtc

SEQ ID NO: 53606 - DNA, 4233 bp, Homo sapiens
agcggacttccggggcggaggaggctgagtggtgcagtgagggacaaacaaaaggaggcgccggagcagcgctgcggccggcggcgggacggagcggccggggcctggggctgcctgccgggcggccgggcgcggcgagcccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccttgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatcagcctctgtgggatcctctagatacactgata

SEQ ID NO: 53607 - DNA, 2647 bp, Homo sapiens
  misc_feature (23)..(23): n is a, c, g, or t
aacagatgaattaaaccctcgtngccgaaattcgggcacggagcaaagtttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccttgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 53608 - DNA, 4272 bp, Homo sapiens
agcggacttccggggcggaggaggctgagtggtgcagtgagggacaaacaaaaggaggcgccggagcagcgctgcggccggcggcgggacggagcggccggggcctggggctgcctgccgggcggccgggcgcggcgagcccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccttgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 53609 - DNA, 2460 bp, Homo sapiens
agcggacttccggggcggaggaggctgagtggtgcagtgagggacaaacaaaaggaggcgccggagcagcgctgcggccggcggcgggacggagcggccggggcctggggctgcctgccgggcggccgggcgcggcgagcccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggcacctgcaccgcctcacctgcctaagctgtgtacgattgcggta

SEQ ID NO: 53610 - DNA, 2366 bp, Homo sapiens
agcggacttccggggcggaggaggctgagtggtgcagtgagggacaaacaaaaggaggcgccggagcagcgctgcggccggcggcgggacggagcggccggggcctggggctgcctgccgggcggccgggcgcggcgagcccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagcctggtctccatgggatcctctaagtcat

SEQ ID NO: 53611 - DNA, 1629 bp, Homo sapiens
  misc_feature (2)..(2): n is a, c, g, or t
  misc_feature (5)..(8): n is a, c, g, or t
gncannnngcctgcctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgc

SEQ ID NO: 53612 - DNA, 582 bp, Homo sapiens
cgagctcggtacccagaggctgaatggagaaataggaacgcttttacactgttggtgggaatgtaaattagttcaaccattgtggaagacagtatggcaattcctcaaagacctagaaccagaaataccatttgacccagcaatcccgttactgggtcccaaaggaatataaatcacccttcagcctctgttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 53613 - DNA, 1533 bp, Homo sapiens
ggatgcgttaattcccttccataatcctcccaggaccgagagggtttcagatcggtgctgggaggggcccagatagttctccccaggacctcttccacctttggaatgcccattacctggagaaggggggtgccgcacatcccccagaccaaccctgcatcccattctatccagattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgc

SEQ ID NO: 53614 - DNA, 1566 bp, Homo sapiens
  misc_feature (2)..(2): n is a, c, g, or t
  misc_feature (5)..(8): n is a, c, g, or t
gncannnngcctgcctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgc

SEQ ID NO: 53615 - DNA, 247 bp, Homo sapiens
tctcccaaaatgcaggggtaatgtgttttttcctcagacagagcacactttaatttattaggtgtttaattagagttggttttgaattagggtcaggaatttggttagggtttgaattagggtcaaggatcttgttcaggttagggttgattaatttgcagctgcagttactctaatgcaattacactttgcagtgcctggaaagtataatgcttaaaaacacagtcgctagttcctggatggggtt

SEQ ID NO: 53616 - DNA, 149 bp, Homo sapiens
ctggccagctttactgttcctcgggttgctgacacccactgcaatctctgcctcctgtgtgtctctgagtgtcaaatctcccactcctttattttataaggacaccagtcattggatttagagcccactctaaatgcagaatgatctca

SEQ ID NO: 53617 - DNA, 99 bp, Homo sapiens
ggaacatttactttgtaagctaggtcacaaacaaatctcaataaatttcaatgagttggaatcagagtatgttttctgactgcaataaaatcaagctag

SEQ ID NO: 53618 - DNA, 980 bp, Homo sapiens
acacattaatcctgtattattactaagttaatcttcctaattatatcgctttcctgatcagaaatgtttaattcctcaaaatctatcaaattaagtctaaatgtcttatccttggttctgtgtactccatactatgacccacctactcagccttttagaggggagactatttcactcctaccctaagccccaggtaacctgttcttgccacaattcattcgcagcctgtaggtctttgcacagtagcagtagcaatagttacaattatagattaactgctatatatgctgctctaagtacttttaatttttcttaacctcataacctaattcacagtgagaaaactgaggcacagtttaagttaaataattagatcaagaatacacagctagtgactatgcaagcattcaaacccaagcaacccagagcccgtgctctgaatcactacaccacacgcattaacaattccccagacaggaacccaagtgtttatccaagtgacaaggacagattataaatgtgttatagccttctctcagactatttcagagatatgtcaagcaattaaacaaaaagtataatatcataaaactaacttgtgtgtgtaccctgtaggattattctcattttatgggatactttatacatttaaatgcaagatggttgctttggtattacatctcaccgtgaggtttcttggtaggacgctatttggagtacgctatgaagacaaagggaaatgccaaataactaaaaagcaatttaagaaacaataaaatgcctctattaaaaaaaatgttaaataatggtaatgtcatgcttaatttaagccagctaacaggattctgctatttatttatttatttatttatttatttattgagatggagtcttgctgtgttgcccagcggagtgctgtggcgtgatctcagcccactgtaacctctgcctgggcaacagagcaagactctgtctaaagg

SEQ ID NO: 53619 - DNA, 1050 bp, Homo sapiens
gaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacag

SEQ ID NO: 53620 - DNA, 390 bp, Homo sapiens
ttgaggtgatgatgaacttggtcacaccacaagtaaagtcagaagtaaggcagaggatgctcagtaggctggtttgatcacctgagatcattaaaaatggctgactgccagctgggcgcagtggctcacacctgtaatcccagcactttgggaggctgaggcaggcagatcacgaggtcaggagatcgagaccatcttggctaacgtggtgaaacgccgtctctactaaaaatacaaaaaattagccaggcgtagtggggggcgcctgtagtcccagctactcgggaggctgaggcaggaaaatggcatgaacccgggaggcggagcttgcagtgagctgagatcgcagcactgcactccagcctgggcaacagagcgagactccatctc

SEQ ID NO: 53621 - DNA, 320 bp, Homo sapiens
aaaacatcactaccttgatgtgagaaccagaccattaagagattgagggccagtggcacaaagacaccctgtggtgaagggaaagaaaggacagtgatgaggtggctgggtcatgtgggcaggtggacaccaagagatgaaaaggccaaggttagcaaggactctagcagggaagctgcggcatcccagggggacacagagggagtagcttcctccaccagctctcatgacaggatgtcctgctcccccagctgttctgtggcacccctgtctgcagagatcttgatggagtttgcacaaggctactttcaatgggaact

SEQ ID NO: 53622 - DNA, 412 bp, Homo sapiens
gctaagtagcctttgcaaataagcaaacatacaatttcaaaaaaaaaggtttcaagggagagatggagaagaatatcgtggaactgtgaaagcagcaattttagtagacaggaagaaccattctttaccgagcactttgagcatccttccacttcagttagcaacttccttcacaaacaaaaacagtgatgttctagccatgatccctctgggttgcgcagggtaacgaggggtcactgggtactcctggcactcgttgagcaggcttgcgaagtcggagcaagcctggcctggcgctaagtaaggatagatgcacttctctgcatgaatcttcggcagctcatgttgcagatagggttaaaggttgtagcggccccgtgttccactagcaaaacatcaaaatgttccttct

SEQ ID NO: 53623 - DNA, 361 bp, Homo sapiens
gtttcggaagaaatgatcagggttagatcacataaagaaagtggtccaattttgttaactttgcatcaattggttaaagtataaaaatttgtcactccatgtagaatgtttgcattctgatttagacaacatctctccagtattttcacttgtgtgtattggaaactgtcttacacagtactgtgaagataggctaagactaaacgggaaatatctgttgaaaatctggcattggattttatctactgatagtcacatttttatatttgactctgggaacaaatctggcctatgcctaaggaggtttgaagccttgacgaaagaactgtagctgactgctgttgattaattacattttcgt

SEQ ID NO: 53624 - DNA, 231 bp, Homo sapiens
tagtagagatggggtttcaccatgttgaccgggctggtctcgaactcctgacctcaggtgatcacctgccttggcctcccaaagtgctgggattacaggcgtgagccaccgcgcctggccttttgtgacttttaatcttgaaggtcacttcgactggaggtaaaaaccttgcttgtgtttttctttcattgaatatctttatttatttttcatttttatttttagagacgg

SEQ ID NO: 53625 - DNA, 282 bp, Homo sapiens
atgtagtgagtggtcgctatgtccaaagtgctgtggacgctgagccaccatgcaaacatgaataagaacagctccttgtttaaatgtgcgcccattcaggtgtcttttctattcatcacagaaagattgagtagaaagctaccaaggtcacccctataaagaaatatttctttacatccattagaatgataacagtaagcgctgacatctcttgagctcctaccatgtgctagccatgattctagactcttgacacatattaactcacaacagccctatgag

SEQ ID NO: 53626 - DNA, 224 bp, Homo sapiens
taatttaaataattgaggaacgacattaaaaaatttaaaagcgacaaaaataaagaactcttccacaattttccagtaattcaattctgcataataattaatatgaaaaaattcatcttttatgtgcaatcataatatgcgaaagaccacaataagatttggccctctgaattgctatcttagtagttgaaaccagctcgatctttcttgtgcattcctccctg

SEQ ID NO: 53627 - DNA, 156 bp, Homo sapiens
attcagctatatgacagaaagtgttaagtgtttggaattccattcttacatttaacacattcagctatatgacagaaagtaaatctatggatatggtattttgtgaatgatcttttaaataaaagaaaaccttacgtaatatttaaaaaaaataaa

SEQ ID NO: 53628 - DNA, 613 bp, Homo sapiens
cttacgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgaggcttttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaaaaaaaataaa

SEQ ID NO: 53629 - DNA, 621 bp, Homo sapiens
cccagcattagcagaccgaaacaggagggaaggaaggagagagagttctgtggattgctgaggccttgtaacaagacacagtaggaaaagcccaggatgacggctggtgagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgaggcttttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaaaaaaaataaa

SEQ ID NO: 53630 - DNA, 520 bp, Homo sapiens
cacggtagattccaaatactaagcacattccgctgggtgccccaggcaccctggccctgcaatcacctggcgagcgctctttcccaggctcctgctgccggccgcccccaaactgctcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgaggcttttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaaaaaaaataaa

SEQ ID NO: 53631 - DNA, 6783 bp, Homo sapiens
cacacttgctggcttgctgggctccactgactggactgaaaacagggccaagaaaactgctgctgcagggggtcctgaaaacagctggaacccggcagtgatgtgggacctaacttgaagttaacctgtggtggtgaggttggaaccagttggattatgatttattttctacactcttgtacggaatgcagagctgttgtatcctgatgaatctactgctaaatatagtcatttggaataattttaagtattgatcttaaaacttgtaccacaacaagagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaagcccagcatggtttgactggatagacacgcataatttattatgaatataaatttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttg

SEQ ID NO: 53632 - DNA, 5635 bp, Homo sapiens
tcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagca

SEQ ID NO: 53633 - DNA, 3482 bp, Homo sapiens
gaaggcacctattttttaatgatcacatggggagtgtttggctttccatttaggataacgtaagctaccttttcactctcattttttttcccaatttcccactaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagca

SEQ ID NO: 53634 - DNA, 4315 bp, Homo sapiens
ttggaagtataagagattatagtgccttgggattttttgttactttcctagcattcaccagcagtttgtcccatagtcaggtgcctgtttcaatgagagaatgtagtatgcagaatgctaaggtttcttcctgaatttcctcatattttaagaaagtgccacaggttgtttttcttctatatggtcaccttgaactattaataggacttaagattttagaccttagtggaggatgctgtgtttactgcttctcaaggatagcatgttttcagtatgaggattatctttggccagactaaggtggaatcaaaggtaggagagaggcagtagcttctgatttgaatattgcctttccctatgtttgaagccctaaaactgctaactgtgtacaactgtgaatttcaaaagtctccccagatgatagaattaactcttaatttaacaagatgtcctttgtgttgagactgagctagactaatagaccgggtatgtatttttaagctctacagcattacttgactaaacctctcttttggtttgtatattaaaattatgccataggcaacctcatctcgcatttaaaacctctcataaattagaaaactttgaatggttctccaaagataatactgggtgttgtacaaaatagcagcacaagccttcttttcctagaaatgggtacagattcattgcaaccacatggcttgggaaagttcaagctgctacccaaccagccttaatttgtgagttacaaatttaatagtacttgattcatagagggaacaaaaaatagacccatagtattatcatctttcaataggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaagcccagcatggtttgactggatagacacgcataatttattatgaatataaatttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttg

SEQ ID NO: 53635 - DNA, 4004 bp, Homo sapiens
tatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagctcaggtactgacactaggagcttctacctgtaccttatgtaaggtagaccctcctagtgtcagtacctgagctagtttacctcagttccgcaggcaggacagcggtccgggaaccctgagtgagaatgagtgtggatgtgtacagacacgcctggacggcagcgggaggctgggactttccattacaaatagagactcaacaggaatgaagtctggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaagcccagcatggtttgactggatagacacgcataatttattatgaatataaatttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttg

SEQ ID NO: 53636 - DNA, 6679 bp, Homo sapiens
tcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtgctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaagcccagcatggtttgactggatagacacgcataatttattatgaatataaatttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttg

SEQ ID NO: 53637 - DNA, 4667 bp, Homo sapiens
tcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaacacatcgatccatgatttacaatttcgagctcgtatccagtcgacctgcagcatg

SEQ ID NO: 53638 - DNA, 4577 bp, Homo sapiens
  misc_feature (4574)..(4574): n is a, c, g, or t
tcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaagcaggaagcagccattttgcagaagcaggcagaagcaggaagggggatactctggngtg

SEQ ID NO: 53639 - DNA, 1592 bp, Homo sapiens
cctgtcccgcagcagtctgcatccccatagcagacacaagggggtttacaaatgtagtccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaaaaaaaaaaaagcccagcatggtttgactggatagacacgcataatttattatgaatataaatttccatgtttgtttctgttcctaaaccagagtacgaggtccctgggaatttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttg

SEQ ID NO: 53640 - DNA, 2812 bp, Homo sapiens
tcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggtaccgtttgttttcctccattctttctttaagttaagagggatcttcaatcctgtgtgccatctgtgccttttaagagagaaatttgtccacagctagcctttaatcaaagagaatgcttttctgggtggtgctgatggctcagagccctaaattaaaagcagtccaacaaaactccccaaaagggccaatggtcctgcttcaaatcttcacaaaagtccccttatctctttggacggtgagaattcgtggataatttttgcacaactgcgtagctcttgattctgtttttctcttctaataaaatatctttattgtagccttccaagttaacaagccagctacaccatcaaatgtaaaaactgttcataataacagtctacaagcacttgaagcttgttttctaagcaatcttttctgagccaggtgagggacatgctttttttcccccccatctctgtaacaattcaagaagagattgcagtctttatacactgtttgttttagttttccttctgaaccagatgtgttttcaacagcatttgcatgtggga

SEQ ID NO: 53641 - DNA, 1227 bp, Homo sapiens
tcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaaggtaaaatttgttaaatcctattttgggatatgattttcatagctatgtcctattattttcttttag

SEQ ID NO: 53642 - DNA, 385 bp, Homo sapiens
taaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaaggtaaaaataaaatgtgcaagcttatactctgagtttctgacctctccatattggtttgctataaccaattatggagtagatttagtcaaatgatacctgtttcatttcagttcaatgcatgtactaagctttctcaggtactcagttctggatggagctgagaatgaaaagtctaagaatgcactttggcattagagatgttcgtgttctattcgggaagagtaggacattcacacaaa

SEQ ID NO: 53643 - DNA, 636 bp, Homo sapiens
  misc_feature (2)..(2): n is a, c, g, or t
gnggagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaaactcaagtctaaccctctcccaccatctctggaatccagccacagactgagaccaatactgcattagctgtgcttgttggtaataacttagtgtaggtaatggatatggcagacttgagtgagaatgagtaacactgtggagaaagggacaggaattacaagagagacccagagaagggcttagtctcttttattgtggattgggcttttagagtatatttagttccagacttgatggctgttatacacctgctgatatatacctgcattgcatgtatctccaccatatgtgggcttgggcaaatctctttaacttcctgaacctcaatttctctatctataaagtgggaacaataatatctattttaaggggtttttgtgacattaagcgagataacatatctgaaagcctctactacagtacctacacaaagaagatggtcaataaatgttattgtttaattcacacaga

SEQ ID NO: 53644 - DNA, 3751 bp, Homo sapiens
  misc_feature (2)..(2): n is a, c, g, or t
gnggagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccacattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtgggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaa

SEQ ID NO: 53645 - DNA, 3737 bp, Homo sapiens
  misc_feature (2)..(2): n is a, c, g, or t
gnggagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaagtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcagctttcaaagtgagatgactctcagattcattgaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccacattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtgggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaa

SEQ ID NO: 53646 - DNA, 3697 bp, Homo sapiens
  misc_feature (2)..(2): n is a, c, g, or t
gnggagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggacctgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccacattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtgggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaa

SEQ ID NO: 53647 - DNA, 613 bp, Homo sapiens
  misc_feature (2)..(2): n is a, c, g, or t
gnggagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggtcagtatagaccttggcaacaactgtctagattagtgtgaagaattggactaggatttagaaaaattctggcttgaccacctactccctatgtaaccataaaaggattcttgaacttc

SEQ ID NO: 53648 - DNA, 3805 bp, Homo sapiens
  misc_feature (2)..(2): n is a, c, g, or t
gnggagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccacattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtaggaaaaagacagttggaaattggtaagggaactgagtacttcaaaccagcacagggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaa

SEQ ID NO: 53649 - DNA, 3752 bp, Homo sapiens
  misc_feature (2)..(2): n is a, c, g, or t
gnggagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccacattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagatttctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtaggaaaaagacagttggaaattggtaagggaactgagtacttcaaaccagcacagggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaa

SEQ ID NO: 53650 - DNA, 3908 bp, Homo sapiens
  misc_feature (2)..(2): n is a, c, g, or t
gnggagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccacattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtgggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaaaacaacagagagaaaacagacaaacacgcgtgtggcagcacgggcctcgaagaagtctcaagacacactgtggccgagcaccagagggagaggaacggccacagcagtacagggaaacgggagaaacagggggaattcaccaaaaaacgccgggcac

SEQ ID NO: 53651 - DNA, 1103 bp, Homo sapiens
  misc_feature (2)..(2): n is a, c, g, or t
gnggagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttgactccatgacactcctctgcctcctgactgaaacccggcttaccctgaggacctgcatctgctgccctctccagggaatgctgccgcttctcccacactccatggacagctgggtcacttctcagaccattgcgctttatgggacactgtcctttgtggtcc

SEQ ID NO: 53652 - DNA, 638 bp, Homo sapiens
  misc_feature (619)..(619): n is a, c, g, or t
  misc_feature (627)..(627): n is a, c, g, or t
aattgtacataattaagtaattactaattgccaggggttgtgctttatatatattatttaatcttcacaacttgttttatatgaagaaaactagtctcagaaatttaactatatagtatgtggtagagctggagttgatttgaatcgccaggtgtttgtgcggtctgggctcttgagcacagttctttactacttcacaaatatgttttactttgtggttcatagttattttcatggagagtttttagttcttctagtgttttgcctctgtcaaattactgccactatcataactattgccttttaagcttgaacaactataactatagttgatcagtaaggaaaaccttacttatctccttgccacgagttttcctttactatatacagaaaagcctaaagaaaataaagatcaccataatcaccagacattactgctgctaaaacttttcttctaatctccctaaaaaatgggactattttctgtctctctacacacacacacacgatttcataaatttttcatgttttgtaataacctctgcaccaggatttcttttctttttttttttgtttgagatgaagtctagcctggtcgacagagtgaaactgtgtcccnggaaaaanaaaaaaaggaa

SEQ ID NO: 53653 - DNA, 476 bp, Homo sapiens
ctatcctcctgccttagcctcctgagtctctgggattacgtgcatgagccatgagccaccacagctggctctgattttaattttttaaattgacagataacattgtgtgtttttatcgtgtataatatgatgttttgaagtatatatacattgtgaatggttaaatctagctaattaacaaatgcattacttcatatagtcatcatttttgtggtgagagcacataacacgtactctacattttttaagaatgcaatatatcgtcattaactgttgtcacgtcgttgtatgctagatctcttgtaatttatttctcctatctaactgtagttacgtattttttgaccaacatctccttgtccttcccatccccgaacagcctcagccccctgtaaccaccattctatagcctacctctatgagatcaactttttaagatcctgcatatgaatgagaccatgtgatatttgtctttc

SEQ ID NO: 53654 - DNA, 638 bp, Homo sapiens
atcagacgaatgagtaacatacaatcaaaatgactggatgatgactggggggacatcaacataaagactatgatgtgcattcaatatttacacgaagaactaggataaatgaaagatgagagagagaaagagagagagcaaacagtatataatggctctgtgctccaacaatgtgggaacaaccttataaagaatgtgtaaggacaggaagaacatatgcaaaaatgtcagtggtaacagtgttgggtggtgttattctaagaatgctttgcgtgtgaatagtaatgttgtctagcttaattctatcacccttggtatttctgaaaaccaggattcttgatatagaagaaacaggggggccaggcgcggtggctcacacctgtaatcccagcacttggcaggctgagatgagtggatcacttgaggtcaggagttcaaggccagcctagccaacatggcgaaaccccgtctctactaaaaatacaaaaattagctgggcgtggtggcacgtgcctgtaatcccagctactcaggaggctgaaggaggagaatcacttgaacccaggatgcggaagttgcagtgacccaagatcacgtcactgcgctccagcccgggcgacagaacaagactctgtctc

SEQ ID NO: 53655 - DNA, 308 bp, Homo sapiens
atctctgctttgtcatctgaaatatggcagaaataatacccatctcttgaatatatcatgagtaaattttttaatgcataaaacctccatgcttctgcatgtagtcagcatacagtaaataaagtttccttctccctaggtaagaaggactgcttcataaattataaagctttatgtgaatgcgagagattgttattaatattgtgctgcttccagattccaacttttacaaaagagttttagaaagagaaaaggaatttagtcattgtctcacaatacctggcataaataagtacacaataaaagtc

SEQ ID NO: 53656 - DNA, 294 bp, Homo sapiens
  misc_feature (1)..(2): n is a, c, g, or t
  misc_feature (5)..(5): n is a, c, g, or t
  misc_feature (288)..(288): n is a, c, g, or t
  misc_feature (294)..(294): n is a, c, g, or t
nnccnctagctctgaggactggccccttagctttaactggatgtttgaagaatgtgaagatgcacggtgaaggctcctctacaggcgtagagatagtgtcatgtttgacctgcaactgcgttatttgtttaaatcatttgttttaaaaaagagttttcttaggtgacattgtggttatattagaagaaaaaagggataggagcccatagtacctcagtgcttttctggcattgataaatcaccaggagcaagcaatctataatttcaattaatattgcattttcaagnataggn

SEQ ID NO: 53657 - DNA, 1860 bp, Homo sapiens
tccccgcgcgctctccgtccgcagtggaagccgccgccgcgctcgcagctcgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcag

SEQ ID NO: 53658 - DNA, 1850 bp, Homo sapiens
agagcagaaaatgttataggtcgtgctcggtttatgtcctgctcgaggcctgtattccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcag

SEQ ID NO: 53659 - DNA, 1810 bp, Homo sapiens
tagggctaggtacgaggctgggtgttgaatcggccgagggtgcgcctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcag

SEQ ID NO: 53660 - DNA, 406 bp, Homo sapiens
ctgacctcgtgatccgcccacctcggcctcccgaaatgctgggattacaggcgtgaaccactgcgcccggcatgattggcattttgggctaaatagtttctgtccacaggaccgtcttgtgcagtgcaggtcttttagcatcctggccactcatagtgcccgtggttctcagtagaagctgtagaggatgttgggaaattggggtgggttggtcacagtgcctggcatctgtctcagggtaagggcttgggaggctcaagtgcagagtcgtatctggatgccagcaacaccctgttgagaaactttctactatggtatgctcatcattctctgaagatgtcagggcctgtttgtttgtttgcctgtttctctcacttttgccttataatcagttcttccttgttgg

SEQ ID NO: 53661 - DNA, 416 bp, Homo sapiens
aaacaataatcaaccccatttacaaaggagtttcaattcatatttttataagaatttcttcaatgaatattctcccgtgagtgtatatgtgggtgagggattctctcagcacctagcacagagcctgacatacaattccctctcataatttatagtaagcacatgagtgaatgaaagtgaattatgcttgtgagagggaaaaagcagctactgatcatagatttttagtgaattcaaaggcctgtggctacaataatataggtaactgtggaaactgtcatgtaaagcaaaagccttgaaatgtacagcctgaagcacacacaattaaaaggatttttctttaaatatgtgaagagcataatcagaaacgaataatatcgtcattgtttgagagaactaaaattgctaggtagaag

SEQ ID NO: 53662 - DNA, 429 bp, Homo sapiens
ctgcccgcagtcatccggaggcctaaacccctccctgtggtgctgtgcttccatggtcacgctccttgtccactttcatgctcttcccgtactcctggttcctctttgaagttcttagaagatagcggtagaagaaatagtgaaaatcttaaagtctttgatcgaatttctgataaatgcacagaagaaaacgctgacgtatgctgccttccctctctgcttcagctacctaaaaggaaagggacccctgtcctatgatcacgtgacttgcttgaccttatcaatcacttggacgacccaccttccttaccctgcctgtcccccttgtcttgtatacaataaatatcagcgcgcccagccattcggggccactaccggtcttcgtgttttggtggtagtggtcccccaggcccagctgttttctattta

SEQ ID NO: 53663 - DNA, 256 bp, Homo sapiens
tcgctggaggctggaatgcagtggtatgatcatagctcactgcagcctcaaaatcctgggctcaagtaatccttctgcctcaggctcttgagtcactgagattacaggcacgagccactgtgcccagctagtatttattcttgaattgttaattttatataaggagatggcctcaaaaacattaacatccatttagtaaacaagctgtcaccacattaaacactaatgtaacatttgtgttgattcatttgaacta

SEQ ID NO: 53664 - DNA, 415 bp, Homo sapiens
ctcggcacgaggtgttaggatggcaggcttgagccaccacgcctggcagctccatctgtgttgactcctgaagcccctcatcttggctaatccggacaggcttgctggggaccccatctccccttggagactttgggatgtggctggatgtccaagtggccggggtcctccacagcccccagcttcccagggcgggaggcaggctgtgtcctcggtgggcactgacagtgaggctgaaacgtttgcacttcacatttccacatttaggggcattttgttgttgactcattcaaagctcttttaagtcgcttaatttgctgctcagagggaaatgaaaagggagccattttccctgatttgtttgcctcatcaacttttcaatcaataaaaaagtgcattttgctcatcggatgca

SEQ ID NO: 53665 - DNA, 535 bp, Homo sapiens
ctcggcacgaggtgttaggatggcaggcttgagccaccacgcctggcagctccatctgtgttgactcctgaagcccctcatcttggctaatccggacaggcttgctggggaccccatctccccttggagactttgggatgtggctggatgtccaagtggccggggtcctccacagcccccagcttcccagggcgggaggcaggctgtgtcctcggtgggcactgacagtgaggctgaaacgtttgcacttcacatttccacatttaggggcattttgttgttgactcattcaaagctcttttaagtcgcttaatttgctgctcagagggaaatgaaaagggagccattttccctgatttgtttgcctcatcaacttttcaatcaataaaaaagtgcattttgctcatcggatgcaaataggtccatctttcctaatatgttgaaatatagtgattcatcagccatttcatttcatctggaagctgaaagcctaatggcgtttggagagaactcctcactcgagaagagtcggtaa

SEQ ID NO: 53666 - DNA, 328 bp, Homo sapiens
ctctgactggtcgtgggcagggagctgggcagcagttcgtgggagcaccaggatgaccccctctggaatgactagggtgagacttccctggtgggatgtcccttgggcacagagccagggccacctcccagcagagagttggacaacgagctttgaggagcaagggagatcttcagcagattagctggacatggtggcaggcgcctataattccagctacttgggaggctgagacaggagaatcgcttgaaccccggaggcagaagttgcagtaagccgagatcgcgccatggcactgcagcctgggcaacagagtaaaattctgtca

SEQ ID NO: 53667 - DNA, 400 bp, Homo sapiens
  misc_feature (367)..(367): n is a, c, g, or t
  misc_feature (376)..(376): n is a, c, g, or t
  misc_feature (385)..(385): n is a, c, g, or t
tcgacaataaaatgacaacctattttaaaaatgagtaaagggtttaaagagacatttctctaaagaatttaaacaaatagccaataaacacatggaaaatgttcaataacattagtcattaaggaattgcaaatcaaaactacttcatacccattaaggtggctaaaatttaaaaagacagacaataactagttattaaggatgaggagaaattggaacactcattcaagcaaataaagttaatgatttatgacatgacactggtcacatctggactccaggtcctaaaaatgagttgaagaccatacaatcacaatacagaaaaagacttgaggatccatctaatcccattgatccttaggtttgntttcgtccncaaaaactnttcattcctgggcaa

SEQ ID NO: 53668 - DNA, 356 bp, Homo sapiens
aaggaaagaaaagtcttggtgaatgtgttccagaagactggaacataatatgcaagattggtaaacaggcaggagccaggttgtgcagtgctgtgtatggattttactctaagagcaaaggaaagccactgaagagtataaagcaggaaagtgtgaattgatttctttttgaaagaatgcccccggctctgtggagaatggattatagcaaaacaacaatggatgcccagaaatcagaaagctaggggtccatgaaaaaggtggtggcttgccgcagggggttgatgctgtaggggataaaaagtaataataacagtagcagtagtagctacaattatattgtgttaactatgtgc

SEQ ID NO: 53669 - DNA, 3405 bp, Homo sapiens
cgctgcgcgcaggccgggaacacgaggccaagagccgcagccccagccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagatgccactgggcactgccctgccagtagtggccttcagggggctccttccggggctccggcctgttttccagagagagtggcagtagccccatggggcccggagctgctgtggcctccactggcatccgtgtttccaaaagtgcctttggcccaggctccacggcgacagttgggcccaaatcagaaaggagagagggggccaatgagggcagggcctcctgtgggctggaaaaccactgggtgcgtctcttgctggggtttgccctggaggtgaggtgagtgctcgagggaggggagtgctttctgccccatgcctccaactactgtatgcaggcctggctctctggtctaggccctttgggcaagaatgtccgtctacccggcttccaccaccctctggccctgggcttctgtaagcagacaggcagagggcctgcccctcccaccagccaagggtgccaggcctaactggggcactcagggcagtgtgttggaaattccactgagggggaaatcaggtgctgcggccgcctgggccctttcctccctcaagcccatctccacaacctcgagcctgggctctggtccactactgccccagaccaccctcaaagctggtcttcagaaatcaataatatgagtttttattttgtttttttttttttttttgtagtttattttggagtctagtatttcaataatttaagaatcagaagcactgacctttctacattttataacattattttgtatataatgtgtatttataatatgaaaca

SEQ ID NO: 53670 - DNA, 925 bp, Homo sapiens
tgcacgaggcagatcagaaaagtaaagaccagttaagaggttggtgaccagataaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagtgtgttggaaattccactgagggggaaatcaggtgctgcggccgcctgggccctttcctccctcaagcccatctccacaacctcgagcctgggctctggtccactactgccccagaccaccctcaaagctggtcttcagaaatcaataatatgagtttttattttgtttttttttttttttttgtagtttattttggagtctagtatttcaataatttaagaatcagaagcactgacctttctacattttataacattattttgtatataatgtgtatttataatatgaaaca

SEQ ID NO: 53671 - DNA, 2918 bp, Homo sapiens
cgctgcgcgcaggccgggaacacgaggccaagagccgcagccccagccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagtgtgttggaaattccactgagggggaaatcaggtgctgcggccgcctgggccctttcctccctcaagcccatctccacaacctcgagcctgggctctggtccactactgccccagaccaccctcaaagctggtcttcagaaatcaataatatgagtttttattttgtttttttttttttttttgtagtttattttggagtctagtatttcaataatttaagaatcagaagcactgacctttctacattttataacattattttgtatataatgtgtatttataatatgaaaca

SEQ ID NO: 53672 - DNA, 1412 bp, Homo sapiens
tgcacgaggcagatcagaaaagtaaagaccagttaagaggttggtgaccagataaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagatgccactgggcactgccctgccagtagtggccttcagggggctccttccggggctccggcctgttttccagagagagtggcagtagccccatggggcccggagctgctgtggcctccactggcatccgtgtttccaaaagtgcctttggcccaggctccacggcgacagttgggcccaaatcagaaaggagagagggggccaatgagggcagggcctcctgtgggctggaaaaccactgggtgcgtctcttgctggggtttgccctggaggtgaggtgagtgctcgagggaggggagtgctttctgccccatgcctccaactactgtatgcaggcctggctctctggtctaggccctttgggcaagaatgtccgtctacccggcttccaccaccctctggccctgggcttctgtaagcagacaggcagagggcctgcccctcccaccagccaagggtgccaggcctaactggggcactcagggcagtgtgttggaaattccactgagggggaaatcaggtgctgcggccgcctgggccctttcctccctcaagcccatctccacaacctcgagcctgggctctggtccactactgccccagaccaccctcaaagctggtcttcagaaatcaataatatgagtttttattttgtttttttttttttttttgtagtttattttggagtctagtatttcaataatttaagaatcagaagcactgacctttctacattttataacattattttgtatataatgtgtatttataatatgaaaca

SEQ ID NO: 53673 - DNA, 813 bp, Homo sapiens
  misc_feature (59)..(59): n is a, c, g, or t
aaattgggcccaatttgggccacttgggcccccccccttttgccccaaggttaagtggncccttttcagggggggctccttccggggctccggcctgttttccagagagagtggcagtagccccatggggcccggagctgctgtggcctccactggcatccgtgtttccaaaagtgcctttggcccaggctccacggcgacagttgggcccaaatcagaaaggagagagggggccaatgagggcagggcctcctgtgggctggaaaaccactgggtgcgtctcttgctggggtttgccctggaggtgaggtgagtgctcgagggaggggagtgctttctgccccatgcctccaactactgtatgcaggcctggctctctggtctaggccctttgggcaagaatgtccgtctacccggcttccaccaccctctggccctgggcttctgtaagcagacaggcagagggcctgcccctcccaccagccaagggtgccaggcctaactggggcactcagggcagtgtgttggaaattccactgagggggaaatcaggtgctgcggccgcctgggccctttcctccctcaagcccatctccacaacctcgagcctgggctctggtccactactgccccagaccaccctcaaagctggtcttcagaaatcaataatatgagtttttattttgtttttttttttttttttgtagtttattttggagtctagtatttcaataatttaagaatcagaagcactgacctttctacattttataacattattttgtatataatgtgtatttataatatgaaaca

SEQ ID NO: 53674 - DNA, 3347 bp, Homo sapiens
tggactcagagcacaattgcgtttcctgcgggttatttttggcgtgggaacgcggggagtacggcggtgagaaaggctgaagctgccagcgccgctgacgggccccttcctgtattttacacctttcgcgaattccgctcctttggaaagggaataatggctttgggatgttgttctgacacagaggaaaaggatatttcagcagcacaacaattctcactttgaaaaggaaaaaagaaaaccattacccacctctggaggcagaacccctgaatgggcaccaaaggaccccctgctcccagggtcctctctagcctggggagcttttctttctttttctcttttttccattttgacctcttttcctctttcccctccctatctgcctccaagaccctgggatatcttaacatccttctattgtcccctttttgaatactatcaggccccctgcacatgcacacacgtagggcagctacgtagcggggctttgggtccctctggcctgttcttgctggcaggcgggggtcatctggataactgggctgattggttggctgatcaccatcatcacagccaagaaggacattggccagccgtcactggcacccttggggactggcgacccttccctgacccgaccctctgccccctcagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagatgccactgggcactgccctgccagtagtggccttcagggggctccttccggggctccggcctgttttccagagagagtggcagtagccccatggggcccggagctgctgtggcctccactggcatccgtgtttccaaaagtgcctttggcccaggctccacggcgacagttgggcccaaatcagaaaggagagagggggccaatgagggcagggcctcctgtgggctggaaaaccactgggtgcgtctcttgctggggtttgccctggaggtgaggtgagtgctcgagggaggggagtgctttctgccccatgcctccaactactgtatgcaggcctggctctctggtctaggccctttgggcaagaatgtccgtctacccggcttccaccaccctctggccctgggcttctgtaagcagacaggcagagggcctgcccctcccaccagccaagggtgccaggcctaactggggcactcagggcagtgtgttggaaattccactgagggggaaatcaggtgctgcggccgcctgggccctttcctccctcaagcccatctccacaacctcgagcctgggctctggtccactactgccccagaccaccctcaaagctggtcttcagaaatcaataatatgagtttttattttgtttttttttttttttttgtagtttattttggagtctagtatttcaataatttaagaatcagaagcactgacctttctacattttataacattattttgtatataatgtgtatttataatatgaaaca

SEQ ID NO: 53675 - DNA, 444 bp, Homo sapiens
ttcccgtactgtgagggggttgtccagcgggcagaaaacccgaacagtggaggactctaacgaaagccacaccagagcctcccttgctccttctagttctccaacaggggaaatgtcccaagccttcctagtggaatgtgactgtgtcacctaccttcccaaaagtggccagcaaaatgagaaatgctgttagtcaactttcaatgtcctctctgcccagtgctttgattccaacagcctgtaaatgctgtttctacactggattagtccttcaaccccaccgcacacgctgtctgctgtactcaatttcatcaatccgcattacctagaggccaagcagacaccatcgtcctcccttgcgggtgagagggtgatggagggaccctcaggagcccagcaggaacaatgtctatctccgcaggctttgcagagatcctggaatat

SEQ ID NO: 53676 - DNA, 323 bp, Homo sapiens
caaatatgaaataattggaaagttgattgcatatttctatgtatataatacccctgggaaccttcaaaaatgtgcgtcacttgggtctttgggtcaattgatctacccaagcaattaatacttattcaggctgttattgtattaatagtaattacagaggacccactaaagagataagactcttctctattatttatgttataggaaacaaacgataagaagcttgtttctaaaattttggtttggctcatgaaatttaaatgtaagacctttttgtccagtatagataagttctgaaataaggcaaaagataaagtaaaaaa

SEQ ID NO: 53677 - DNA, 386 bp, Homo sapiens
tcagcggtggccttcaggctcaaaattgttggaattctctcctgccttcttgggtgccatctccccatatgccctcttgcttacatttcaaatgatttctattcatttgattcaaacctttaatatggttttctctgaaatacgtgcagaggatctggcaatctgttgtgcctgcttctagttcttgagatgacatttactaaattaaaaaatacataattatgtttttataaatttataaacatgttatacgatacatttgtgtgtgtgtgtgtgtgtgtgtgtgtgtgtgtgtgtgttttaggcagaggtatacaattccttaacctattaaatgaactccactgaatttgaatgagattttggggtgaggattcacaaacttt

SEQ ID NO: 53678 - DNA, 250 bp, Homo sapiens
cacccttgtcaccagataaccagtatacctctacagagaacatggtcatgagctgtgaattctctccattcctggaccccttgttacagatgatttagttactccaacatccatccttaccacctgtctcaggaaggaggtgcccttcctcctgtgcccagcatctccctttcacacctacttggtctccttgctccaacaattaatagcctatctttctgtcccttctttttcttcaaatagcctgcag

SEQ ID NO: 53679 - DNA, 2804 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 53680 - DNA, 2750 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 53681 - DNA, 2693 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcatcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 53682 - DNA, 2692 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgttattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 53683 - DNA, 2725 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 53684 - DNA, 788 bp, Homo sapiens
ccggcacgaggccaggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggccacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagcattctcactgtgacgact

SEQ ID NO: 53685 - DNA, 300 bp, Homo sapiens
ggcacgaggccaggagttgtgagtttccaagccccagctcactctgaccacttctctgcctgcccagcatcatgaagggccttgcagctgccctccttgtcctcgtctgcaccatggccctctgctcctgtgcacaaggtgagtctgtcatccatgtgctttgatggctccctgggcagaagtcaggcgacatcttccaagtgctgtggcctgaaaaccctcgtgtgaaattagggatcctcaaatggggtttcaaagtgacatcattgttttcttcaagaaggttgaaaagcagtctat

SEQ ID NO: 53686 - DNA, 1746 bp, Homo sapiens
cacccacttccgggtctcctctgtttacgaatgtttgggcgcgaattactctaagcgcggctctcagaagggtgcaagaagaatcagtgcactgtgtttagatcaagatgtctggtaaagcaaatgcttccaagaaaaacgctcaacagttaaaaagaaatccaaagagaaaaaaggataatgaggaagttgtgttgtcagagaataaggttagaaacacagtgaaaaaaaataaaaatcatctgaaagatctgtcttctgaaggacaaacaaagcacactaacctaaaacacggaaagacagcagccagcaagagaaaaacctggcaacctctgtcaaagagtaccagagaccatttgcaaactatgatggaatcagtaataatgacaattttgagtaacagtattaaagaaaaagaagaaatacaataccatctcaacttcctgaagaaaagattgctacaacagtgtgaaactctgaaagtccctcccaaaaagatggaagatttaactaatgtatcaagtctactgaatatggaaagggcacgagacaaagctaatgaagaaggtctggcattactacaggaagaaatagataaaatggtagagaccacagagttaatgactgggaatattcagagcctaaagaacaaaattcagattctggcaagtgaggtggaagaagaagaggagagagtaaaacagatgcatcaaataaatagtagtggagtactctctcttccggaactttctcagaaaactctcaaagcacccacacttcagaaagaaattttggcgctaattccaaaccagaatgctcttctaaaggacttggatattcttcataattcatcacagatgaagagcatgtcaaccttcattgaagaagcctataagaaactggatgcatcttaaagagtgttttttttttagattgttccatattaatttaatgttcgtgaatttgtaaaactgttaacctatgattatatgtacagaggctaaggcttctgcaggatttattatctcctgatatgcactttaaaattagtctttgtagttctatcattagcatctaatgtagttctgaagactgtttttagcagttgccaaatctaggaaactaacatttatattgctgtatctataagtatttgcctaaaaccataaaataggaattgccttaaggatctaatagtttataatgcctgaatggaactcatttattggttaacagctcatatcaggagctgtgataagtaagtgtttacatacactgtctagtgcataaaaaccttagtgtttgctatcattcattctgtagccaatggcttacagtttctgtctggtcatctggaacttgaaaaatcctcaaatgccttcactcttttacctaactccctagtctttttgggaagtagttaagatatgcctgctatctttaactttggaggtagtatcaaaattttacttctttggttgtttagtgaattaatgttgaatattttctactgtcatcaaaacatattcccaaaaagtattaaaaaggaaccttagcacatttattttattaaaacaagaaaacccaaaatatataaaccttttcttattatgataataagcttatatatgtgaataagttataacctagtgtataaaaaattatttctaacaaactacagtatactgtcttgggttgtttttttttttttagtctgtaaaataaaatgactgcaattacttttta

SEQ ID NO: 53687 - DNA, 2041 bp, Homo sapiens
tttagaagccaaaatatatttcttgaggaagactactctcccagcaatagttctgcatccagtatttggaaaagacatagatatagcatcaactttattgctgaacaagatttaagagttattacttatgtatattttctgtgtggcttatttacttgttccccaaagcatacaggcaatgttatcattgactgttgctaggaccatatttgaaagcagtgccatgtttaataccctttagaaacctggaggcttgctaattttaattttatacttggcctgcacacaacacatccttgatgtgttgtccccatacttgttttattcatttcttattttcttttcatcttcctctctaaattatgtattcctttaatgtgggaaactgttactctttttttttattctccctgctctaatgcccaacattacttccttttgacaaattaaaatagcaggctcttaaatgttcctaaataaatgaaaacaattcagaatttctccactacatgaagttttatgctgcttaaggaaggttgctgtatttgttgtcatcagttctgggctctgctagatttacacttggatcttccaggatctctgaccctaccagcattggtacgttttgaggaagtgttcatgtacatctccttattccagggaaattagatatccttataacacattaataccttgacataccagctttccaagaagtctcttttttgaaagaaacaaaagtaaattcaccagttgcttctaaaaatgttttaaatatatatggtgtttttttaaaatgtgtatgtataacaatatctattaggatttaatataataatgtgtttaagttaaaatgttttttttctctttctgactcaggaagaaatagataaaatggtagagaccacagagttaatgactgggaatattcagagcctaaagaacaaaattcagattctggcaagtgaggtggaagaagaagaggagagagtaaaacagatgcatcaaataaatagtagtggagtactctctcttccggaactttctcagaaaactctcaaagcacccacacttcagaaagaaattttggcgctaattccaaaccagaatgctcttctaaaggacttggatattcttcataattcatcacagatgaagagcatgtcaaccttcattgaagaagcctataagaaactggatgcatcttaaagagtgttttttttttagattgttccatattaatttaatgttcgtgaatttgtaaaactgttaacctatgattatatgtacagaggctaaggcttctgcaggatttattatctcctgatatgcactttaaaattagtctttgtagttctatcattagcatctaatgtagttctgaagactgtttttagcagttgccaaatctaggaaactaacatttatattgctgtatctataagtatttgcctaaaaccataaaataggaattgccttaaggatctaatagtttataatgcctgaatggaactcatttattggttaacagctcatatcaggagctgtgataagtaagtgtttacatacactgtctagtgcataaaaaccttagtgtttgctatcattcattctgtagccaatggcttacagtttctgtctggtcatctggaacttgaaaaatcctcaaatgccttcactcttttacctaactccctagtctttttgggaagtagttaagatatgcctgctatctttaactttggaggtagtatcaaaattttacttctttggttgtttagtgaattaatgttgaatattttctactgtcatcaaaacatattcccaaaaagtattaaaaaggaaccttagcacatttattttattaaaacaagaaaacccaaaatatataaaccttttcttattatgataataagcttatatatgtgaataagttataacctagtgtataaaaaattatttctaacaaactacagtatactgtcttgggttgtttttttttttttagtctgtaaaataaaatgactgcaattacttttta

SEQ ID NO: 53688 - DNA, 1614 bp, Homo sapiens
agattttttttttttcgaagcactgtgtttagatcaagatgtctggtaaagcaaatgcttccaagaaaaacgctcaacagttaaaaagaaatccaaagagaaaaaaggataatgaggaagttgtgttgtcagagaataaggttagaaacacagtgaaaaaaaataaaaatcatctgaaagatctgtcttctgaaggacaaacaaagcacactaacctaaaacacggaaagacagcagccagcaagagaaaaacctggcaacctctgtcaaagagtaccagagaccatttgcaaactatgatggaatcagtaataatgacaattttgagtaacagtattaaagaaaaagaagaaatacaataccatctcaacttcctgaagaaaagattgctacaacagtgtgaaactctgaaagtccctcccaaaaagatggaagatttaactaatgtatcaagtctactgaatatggaaagggcacgagacaaagctaatgaagaaggtctggcattactacagaacaaaattcagattctggcaagtgaggtggaagaagaagaggagagagtaaaacagatgcatcaaataaatagtagtggagtactctctcttccggaactttctcagaaaactctcaaagcacccacacttcagaaagaaattttggcgctaattccaaaccagaatgctcttctaaaggacttggatattcttcataattcatcacagatgaagagcatgtcaaccttcattgaagaagcctataagaaactggatgcatcttaaagagtgttttttttttagattgttccatattaatttaatgttcgtgaatttgtaaaactgttaacctatgattatatgtacagaggctaaggcttctgcaggatttattatctcctgatatgcactttaaaattagtctttgtagttctatcattagcatctaatgtagttctgaagactgtttttagcagttgccaaatctaggaaactaacatttatattgctgtatctataagtatttgcctaaaaccataaaataggaattgccttaaggatctaatagtttataatgcctgaatggaactcatttattggttaacagctcatatcaggagctgtgataagtaagtgtttacatacactgtctagtgcataaaaaccttagtgtttgctatcattcattctgtagccaatggcttacagtttctgtctggtcatctggaacttgaaaaatcctcaaatgccttcactcttttacctaactccctagtctttttgggaagtagttaagatatgcctgctatctttaactttggaggtagtatcaaaattttacttctttggttgtttagtgaattaatgttgaatattttctactgtcatcaaaacatattcccaaaaagtattaaaaaggaaccttagcacatttattttattaaaacaagaaaacccaaaatatataaaccttttcttattatgataataagcttatatatgtgaataagttataacctagtgtataaaaaattatttctaacaaactacagtatactgtcttgggttgtttttttttttttagtctgtaaaataaaatgactgcaattacttttta

SEQ ID NO: 53689 - DNA, 1348 bp, Homo sapiens
acaaaattagccaggtgtggtggcacatgcctgtaatcccagctattcgggaggctgaggcaggagaattgcttgaacctgggagctggaggttgcagtgagccaggactgcgccattgtactccagcctgggcaagaagagcaaaactccacctcaaaaaaacaaaaacaaacaaacaaacaaatcctatcatttaccagtggtgaaaggagcaggatggggagagggagagatagatttgaaagaagaatggcgattcgttgacaattattgaagttggatgatagatacttaaggtttattttactgttctctctaacatacatttgagatttctcataataaaatgttaacaactacatttaatactatctttcccacagaaagaaattttggcgctaattccaaaccagaatgctcttctaaaggacttggatattcttcataattcatcacagatgaagagcatgtcaaccttcattgaagaagcctataagaaactggatgcatcttaaagagtgttttttttttagattgttccatattaatttaatgttcgtgaatttgtaaaactgttaacctatgattatatgtacagaggctaaggcttctgcaggatttattatctcctgatatgcactttaaaattagtctttgtagttctatcattagcatctaatgtagttctgaagactgtttttagcagttgccaaatctaggaaactaacatttatattgctgtatctataagtatttgcctaaaaccataaaataggaattgccttaaggatctaatagtttataatgcctgaatggaactcatttattggttaacagctcatatcaggagctgtgataagtaagtgtttacatacactgtctagtgcataaaaaccttagtgtttgctatcattcattctgtagccaatggcttacagtttctgtctggtcatctggaacttgaaaaatcctcaaatgccttcactcttttacctaactccctagtctttttgggaagtagttaagatatgcctgctatctttaactttggaggtagtatcaaaattttacttctttggttgtttagtgaattaatgttgaatattttctactgtcatcaaaacatattcccaaaaagtattaaaaaggaaccttagcacatttattttattaaaacaagaaaacccaaaatatataaaccttttcttattatgataataagcttatatatgtgaataagttataacctagtgtataaaaaattatttctaacaaactacagtatactgtcttgggttgtttttttttttttagtctgtaaaataaaatgactgcaattacttttta

SEQ ID NO: 53690 - DNA, 390 bp, Homo sapiens
aaaagagaatgtggaacatttacaggatagttttttaaacaaaacattgtgcaaggctttagctttttttgtattattttcatctttacagattttttttttttcgaagcactgtgtttagatcaagatgtctggtaaagcaaatgcttccaagaaaaacgctcaacagttaaaaagaaatccaaagagaaaaaaggataatgaggaagttgtgttgtcagagaataaggtaatgaaaatatcaagtttctcatttagaaatcttcaactgtggccaagcactatggctcatgcctgtaatcccagcactttgggaggccgaggtgggtggatcacgaggtcaggagatcgaaaccatcctggctaacatgatgaaaccccgtctctact

SEQ ID NO: 53691 - DNA, 709 bp, Homo sapiens
cacccacttccgggtctcctctgtttacgaatgtttgggcgcgaattactctaagcgcggctctcagaagggtgcaagaagaatcagtgcactgtgtttagatcaagatgtctggtaaagcaaatgcttccaagaaaaacgctcaacagttaaaaagaaatccaaagagaaaaaaggataatgaggaagttgtgttgtcagagaataaggttagaaacacagtgaaaaaaaataaaaatcatctgaaagatctgtcttctgaaggacaaacaaagcacactaacctaaaacacggaaagacagcagccagcaagagaaaaacctggcaacctctgtcaaagagtaccagagaccatttgcaaactatgatggaatcagtaataatgacaattttgagtaacagtattaaagaaaaagaagaaatacaataccatctcaacttcctgaagaaaagcttgctttctttagttcctgaagtcaccatacccaagatacagttacttctaccaatacaacaaagtacaacattagcaaactgatcctaattggaactctaaatacatttttctgtagcagtgtttctgaaagtatatttgaaacacttgttcttacagatagtctatggataaaagtaacctatggtgaattatatttgggtaccttagcatgtaagaagccctgcagtaaataaatctatttcattttcttt

SEQ ID NO: 53692 - DNA, 1673 bp, Homo sapiens
cacccacttccgggtctcctctgtttacgaatgtttgggcgcgaattactctaagcgcggctctcagaagggtgcaagaagaatcagtgcactgtgtttagatcaagatgtctggtaaagcaaatgcttccaagaaaaacgctcaacagttaaaaagaaatccaaagagaaaaaaggataatgaggaagttgtgttgtcagagaataaggttagaaacacagtgaaaaaaaataaaaatcatctgaaagatctgtcttctgaaggacaaacaaagcacactaacctaaaacacggaaagacagcagccagcaagagaaaaacctggcaacctctgtcaaagagtaccagagaccatttgcaaactatgatggaatcagtaataatgacaattttgagtaacagtattaaagaaaaagaagaaatacaataccatctcaacttcctgaagaaaagattgctacaacagtgtgaaactctgaaagtccctcccaaaaagatggaagatttaactaatgtatcaagtctactgaatatggaaagggcacgagacaaagctaatgaagaaggtctggcattactacaggaagaaatagataaaatggtagagaccacagagttaatgactgggaatattcagagcctaaagaacaaaattcagattctggcaagtgaggtggaagaagaagaggagagagtaaaacagatgcatcaaataaatagtagtggagtactctctcttccggaactttctcagaaaactctcaaagcacccacacttcagaaagaaattttggcgctaattccaaaccagaatgctcttctaaaggacttggatattcttcataattcatcacagatgaagagcatgtcaaccttcattgaagaagcctataagaaactggatgcatcttaaagagtgttttttttttagattgttccatattaatttaatgttcgtgaatttgtaaaactgttaacctatgattatatgtacagaggctaaggcttctgcaggatttattatctcctgatatgcactttaaaattagtctttgtagttctatcattagcatctaatgtagttctgaagactgtttttagcagttgccaaatctaggaaactaacatttatattgctgtatctataagtatttgcctaaaaccataaaataggaattgccttaaggatctaatagtttataatgcctgaatggaactcatttattggttaacagctcatatcaggagctgtgataagtaagtgtttacatacactgtctagtgcataaaaaccttagtgtttgctatcattcattctgtagccaatggcttacagtttctgtctggtcatctggaacttgaaaaatcctcaaatgccttcactcttttacctaactccctagtctttttgggaagtagttaagatatgcctgctatctttaactttggaggtagtatcaaaattttacttctttggttgtttagtgaattaatgttgaatattttctactgtcatcaaaacatattcccaaaaagtattaaaaaggaaccttagcacatttattttattaaaacaagaaaacccaaaatatataaaccttttcttattatgataataagcttatatatgtgaataagttataacctagtgtataaaaaattatttctaaca

SEQ ID NO: 53693 - DNA, 1104 bp, Homo sapiens
tcttcactgtgttgcccaggctggtctcaaactcctgagctcaagcaatcctcccatctcagccatctcagtgctgggattacaggcatgagccaccacacccaacaagctaagaatggcttttacatttaaaaaatgtgttgttaagtacacacacactcacgaatacattaacaggaccatttttggcccacagagcctaaatatttaatatgtagccttcttcaaaaaaaaatttgccatatctagaactagagaacaagcttcagaccaaaacaaccagaaacactggtgtaagaactggagcaaagcactaaacacagagctacttagcaaatcaattctaaagaagactttcagggagaattcaatatgtaatggctatatggcccaacagtgaacatgaagatgtataaacttttttcataagtttcatagtagcaatcataattagtaattatgtctaagtgatcataattagtagtggtggtactggcactgcaactctgagactgctgtgtatatatgagatgaatcaaatgggatagtctatcattccctgttgtcttttagggggatctagtttttgcgatgcatttaataggctattcattcactacaattctcaaggaaaacattcttgttaaagccagttcattttggactaatagcagattatcaaatctggtcatctaccttatttggcctgagatcctcttggtggttttcaacaaattcaccctcagaagacaaagcttttgagatgcaggatatactgcagcgtgaccaaattctaaggcctcaaaagagaattctagtcccagttctatgactatttagctgtgccacaactctctagacctgcttacctaactttttaaaatttatttatttatttatttatttatttgagacagtctcactctgtcaccaggctggaatgcagtggcgtgatctcggctcactgcaacctccacctcccaggctcaagcgactctccttcctcagcctcccgaggagttgggaccacaggtttgttctaccacgcctggctaatttttgtatttttagtacagacagtttcaccatgttggccaggctggt

SEQ ID NO: 53694 - DNA, 1159 bp, Homo sapiens
tcttcactgtgttgcccaggctggtctcaaactcctgagctcaagcaatcctcccatctcagccatctcagtgctgggattacaggcatgagccaccacacccaacaagctaagaatggcttttacatttaaaaaatgtgttgttaagtacacacacactcacgaatacattaacaggaccatttttggcccacagagcctaaatatttaatatgtagccttcttcaaaaaaaaatttgccatatctagaactagagaacaagcttcagaccaaaacaaccagaaacactggtgtaagaactggagcaaagcactaaacacagagctacttagcaaatcaattctaaagaagactttcagggagaattcaatatgtaatggctatatggcccaacagtgaacatgaagatgtagtacaccaaaaaaggagggggcaggatgagaaaagcatcttcaatttaaaaattttaaacttttttcataagtttcatagtagcaatcataattagtaattatgtctaagtgatcataattagtagtggtggtactggcactgcaactctgagactgctgtgtatatatgagatgaatcaaatgggatagtctatcattccctgttgtcttttagggggatctagtttttgcgatgcatttaataggctattcattcactacaattctcaaggaaaacattcttgttaaagccagttcattttggactaatagcagattatcaaatctggtcatctaccttatttggcctgagatcctcttggtggttttcaacaaattcaccctcagaagacaaagcttttgagatgcaggatatactgcagcgtgaccaaattctaaggcctcaaaagagaattctagtcccagttctatgactatttagctgtgccacaactctctagacctgcttacctaactttttaaaatttatttatttatttatttatttatttgagacagtctcactctgtcaccaggctggaatgcagtggcgtgatctcggctcactgcaacctccacctcccaggctcaagcgactctccttcctcagcctcccgaggagttgggaccacaggtttgttctaccacgcctggctaatttttgtatttttagtacagacagtttcaccatgttggccaggctggt

SEQ ID NO: 53695 - DNA, 141 bp, Homo sapiens
aatggggactcctagaagccagaggccatgttctcttcatctcaggacccccttcaccagcaccagtctttctgacccccagccaggacccagtgcataagaaatgtgaattactgagccagctctggctgagcctggatg

SEQ ID NO: 53696 - DNA, 241 bp, Homo sapiens
cgtcctgacaggctgcccttggcttgcactaccggcctggatcccatgcctgccaagggtgagccaagcatggagggccgaggagtgtgtgagcgagcatagggtttggccactgtgtacagccaggcacaccagttgtggtagggtgggcagctcctggcaccggcttgggtgttagctccctgcaaggttgcagctggaccatgcataccacaagcatcttccacggctggcactaggg

SEQ ID NO: 53697 - DNA, 512 bp, Homo sapiens
acccatctgtgatccatcttgaccttttttctcctctctcagctgttcatcagggagcctccactgcagccataggcatgggtacttgctgagggagaggaaacaatagtggtgatgtgggggtctgagccacctgctcatatagctcctggtgatctctggctctgcttgtacttcatactgaatgaaccacttgcatcttagagactcacctaaaagagcccagctcatcatgggtggctctcttcagccacagtaaatgcctgaagagggacttggctgagtcctcagcagccaacactttgacagctgggggagtgagtacctcgtccttaaaagggaaattaggaaagtgcattacagagcccacatcagcatcgaatctccaacacaagtctatgaagaagctagggatggcattaatactgccatcttgcagatcaagaatctgaagtatcacaaggttaaacaacttcttcagttcatggaaaatcaatccagcctcagaacaa

SEQ ID NO: 53698 - DNA, 449 bp, Homo sapiens
taggccacaggatccacctacacttcagaagcaaagaaatgatgttgagagaagctaaatgaatgttccaaggtgacacactggcacgagtgaattgtgctgggtggttggcaaagccaggcattttcaggggcttttctgtgatcttatcctgtctcttaaaagcagctggtactcctgactccctactctaggttatgccaaacagaggttgaggcctgagacagacatttgtcctcttgccctggagctaagcaatagcttctgtattgtgtttgcccgcagaggaccacagggtgtcactcagtcaccttggccagcgccacttagaatgcatctgtaccgagcctcacttatgcctcctgccctcactgccctcactggaagcaccttccccacctgcccctcagaaaggcccccacaggacctgggggcctgggctttgcaga

SEQ ID NO: 53699 - DNA, 630 bp, Homo sapiens
gtttttaaggttcacaagtgtgccgtgtgtggcttcaccaccgaaaacctgctgcagttccacgaacacatccctcagcacaaatcggatggttctttctaccagtgccgggagtgtggcctctgctacatgtcacgtctctctgtccaggcacctctttgttgtacacaagttaaaggaacctcagccagtgtccaagcaaaacggggctggggaagataaccaacaggagaacaaacccagtcacgaggatgaatctcccaatggcgccatgtcagacagaaagtgcaaagtgtgcgcaaaaacttttgaaactgaagctgccttaaacactcacatgcagacacatggtatggccttcatcaaatccaaaaggatgagctcagacgagaaatagccacagacgctccatgaggaaaatccctgtccacattggcataagacacttttgttacacaaagtttgcagtataatagagttaacaatactgtctaggctgttgcaatatattctctttcaacgtgccttccttcttcatcttgtcatatatatcctcattaagtattaaaacagattttgagtttaaaagagtttgtatatatttaaatgaataactttttatactctttg

SEQ ID NO: 53700 - DNA, 362 bp, Homo sapiens
cgcagccagagacaacatgtaaacagcggagcagggctccgttcccacagcgcgggatctgggtcccagtttgcacagccctgagtcgagggtggatccaatccaggtctgatacagcatttcaatggtgatgccgcagccttccacactgaggcacttaacaccccattgttcccaattgcattttaactgaaaaaatacaaaaagagatcaaaactgaaagtgcagtttcctcatggtcccaccacattttggagaagtgtataaatggagaagtgaaagctccatcttctgccccttccccatgagagagcctctattcacagccaggtcagtttcttccagactgttaacatccgtgt

SEQ ID NO: 53701 - DNA, 787 bp, Homo sapiens
atttaatttttataaagaaaaacttagggctttagatgctttcagtaaaatttaaagcctactgaagttttgtttagattttagtttaaatctatgattgtcttgatttattgatcttctttgactggtggagtagaaagaaataactttctctatgcacagattttatacaaaaacgatttttctcagtgctttctgttttatttagatgtttggaagccaaattctgtgtgtcttgttcacatagtagtaagaagtagcaagaagactataacttaaatagacaaaaagttattgttggggcattgtatatcatatggagctgtactttctagaatttctagggtactttatgtttcttgctccctaaaaagaaaaacaaattagttatataatagtaaattaaaattgtataatataagccctacatgggtatttgtggcaattcaggagtaattgctttatcatcattctgttcagaagtaattgcattgcttttggtgactgtagcttacatttagaattcagtcagttgggtcatatgccatttttataaatggagaatataatgccataaactgtaaatttttgaagatatatggattctgattttgctgaatattttaggttttttgtttgttgtaaaaactgtatttctaccaaaggaatagaatgttaaatgcttattcagtaagaattctaaagcatgagttaagttggaataaatgacttaaaattatttcttaatttgttatgaataaactttttttgaagtttaaatctgagt

SEQ ID NO: 53702 - DNA, 460 bp, Homo sapiens
agtctttgattattaaccactagccccatttgaaaccccatcgcatttgatggcaatggaccttatgaagagaaccaaagtaccaattaggccaaactgcacacgggcttggatggacaggctcagaattcattttccagccgttgcgagggctcacactgactcatccacattcccacctggctttccagagggaactatgctaaaatgatgctaaagagaccagactgctttctttttttgtgcgtgtgacagagtctcgctctgtcacccaggctagagtgcagtggcacaaccacggctccctgcagcatcaacctcccagattaatcaatcctcccacctcagcctcctgagtagctgggaccacaggtacacaccactgtgcccagctaatttttgtgatttttgtaaagattgagtccccctgtgttgcccaggctggtctcaaactcctggg

SEQ ID NO: 53703 - DNA, 535 bp, Homo sapiens
ttgatttttgcacaggaaatagtcacatgtacaaactcaaaagataaaaagagtatacatatagtgaaaagtctcccactcctgtctcttagccactcagttttccctcttgaatgtagccaaggttactaatgcatagatatgttatgcgtatacaaggatgtacacatatattttgtaaatataagtatacataaagagcttctactaatttttttctactacataatattctgtgtagatatattataattttttaggcagtcccttatttgtgaacatgtaggttgttcctaatctttttcttttgtaaatgatacctattttgcacatttgtgagtatacctgtagaataaaatcatagggctagaattgctgagttaagaggtatatgcattttttatttttatgttttttagagatgaggatctcactatattacccaggctggcctcaagcttctgggcccaagtgctaccatagataccactgcactccagcctgggtgacagagcgagacactgtctcaaaaaaa

SEQ ID NO: 53704 - DNA, 510 bp, Homo sapiens
aacaaatattatgtgccaacacttacaaatagtaactcatttaattattttaaccttgctggtagatatggttattctcctctctccctcatagatggggaaactcaggcaagatgaagttaagtaacttgcgcagggtcatacacgagtggcagggccagagtctgaatccagacagttggctccagacgccagactcctagccactgctttgtgctgcccctctttcctctgctagttaagtcgaaaaagttgtttgtgattctgcatcttgctttcctcttctcttattaattatagtataatgggtgtcactcttattaccataagccttagtatggcattgcgagcaccagttaattaagcaataacgttttgagatccctaattggaagaattcagagcggtgtattgctttgagttagttggccctttgctgcaactctggccatgagacaacgttatcttgaatagtgataatgtgtaaaaagatgaggcctcctttttttt

SEQ ID NO: 53705 - DNA, 4520 bp, Homo sapiens
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaaatgtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatccgcccgcctcggcctcccaaagtgctgggattacaggcatgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcaccta

SEQ ID NO: 53706 - DNA, 1692 bp, Homo sapiens
  misc_feature (1)..(2): n is a, c, g, or t
  misc_feature (9)..(9): n is a, c, g, or t
  misc_feature (11)..(12): n is a, c, g, or t
  misc_feature (19)..(20): n is a, c, g, or t
  misc_feature (27)..(27): n is a, c, g, or t
  misc_feature (48)..(48): n is a, c, g, or t
  misc_feature (56)..(57): n is a, c, g, or t
  misc_feature (72)..(74): n is a, c, g, or t
  misc_feature (80)..(81): n is a, c, g, or t
  misc_feature (89)..(89): n is a, c, g, or t
  misc_feature (95)..(95): n is a, c, g, or t
  misc_feature (113)..(114): n is a, c, g, or t
  misc_feature (125)..(125): n is a, c, g, or t
  misc_feature (132)..(132): n is a, c, g, or t
  misc_feature (134)..(135): n is a, c, g, or t
  misc_feature (144)..(145): n is a, c, g, or t
  misc_feature (149)..(149): n is a, c, g, or t
  misc_feature (156)..(156): n is a, c, g, or t
  misc_feature (224)..(224): n is a, c, g, or t
nntttgagncnnagtctcnntctgttncccaggctggagtgcagtggnacaatctnngctcactgcaacctnnncctccnnggttcaantgattntcctgcctcagcctcccnngtagctgggantacaggnanntgccaccanncccngctaatntttgtatttttaatagagacagggtttcaccgtgttggccaggctgatctcgaactcatgacctcaantgatccacctgcctcggcctcccaaattaatgggattataggtgtgggccaccgcacccagccagtgttagatttttgaaatctgaatttagcctgcatttttattatgttttctggttttcctgttatcttctagactataccctgttaccatcatctccttctaaaataatatgattttcagtgacacaatttgatattaaccataattgtcttctctctgcttccctttgtatcgtatgtcttgtgttttttgtttttctctttccaagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtaaaattacttttacataaaagcttgtaatgtgttgtgtgttttgcttaactctcttgactatacagggttttccagaataagaattgttttagcttccctcagaagagtcatagagacattgatttcattcataaaatcatgtactgctgtggctttctgatagttatttcctccaagaaagaacttgactaggtatcctttgcattatacatagagcaagtagtagcctctttacacttcttttgacatgacaacaaatatattttaatttctttcctagaaaggccagaggttctcagtcagaggagatattgccctgtaccgccactcaccaggggacatctgacaatgtctacagacttttttggtggttacaacctgggggctactgcttgacatctagtgggtagaggccaggtatactgctgaacctcctacagtgtacagaaatgtgcaggcaaacccccccttccccccacaacagaattatcaggcccaaaatggtagcggtgctgagattgagaaaccctgctttagacatagtgctttctttcaacctccatacttctgtacagttacctccatctgtaatgtttgttgttgttgtttttcgagatagggtctccctctgttgctcaggctagagtatagtggcgtgatttcagctcactgcagccttgacctcctggggctcaggtgatcctcccacctcagcctcctgagtagctggaactacaggtgcacactaccacgcctgactaattctttgtattttttgtagagacgaagttttgccatgttgcccaagctggtctcgaacttctgggctcaagcagtcctcctgccttggcttcccaaagtgctaaaatggcaggcgtgagacaccatgcccggcctgtaatctttacatgtgaaaatcctaaccattctttagggcctaatttagctgccactttttttttcaatagtttttgggaaactagttctttagtggtgatttcagtgcacccatcacccaagcatcttgcactgtacccaa

SEQ ID NO: 53707 - DNA, 372 bp, Homo sapiens
tactactactaaattcgcggccgcgtcgacagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctaaaaaaaaagtcgacgcggccgcgaat

SEQ ID NO: 53708 - DNA, 4489 bp, Homo sapiens
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaaatgtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcacccttgtgatccgcccgcctcggcctcccaaagtgctgggattacaggcatgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcaccta

SEQ ID NO: 53709 - DNA, 2745 bp, Homo sapiens
  misc_feature (2710)..(2710): n is a, c, g, or t
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaacnaaccccaccgggaattttggctaattcccagggga

SEQ ID NO: 53710 - DNA, 4388 bp, Homo sapiens
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaaatgtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatccgcccgcctcggcctcccaaagtgctgggattacaggcatgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcaccta

SEQ ID NO: 53711 - DNA, 4671 bp, Homo sapiens
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaaatgtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatccgcccgcctcggcctcccaaagtgctgggattacaggcatgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattg

SEQ ID NO: 53712 - DNA, 4781 bp, Homo sapiens
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaaatgtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatccgcccgcctcggcctcccaaagtgctgggattacaggcatgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaagagagagaagaaacacaaacaggcggcgggcggaggggccgctccaccaccacacagagaggcgggagcgcagcaaccccaagagcgggaggaggccgccgcgcgggaaaaaaacgatccgccgcgccagcccgggcgcacaccaccacgcggggacc

SEQ ID NO: 53713 - DNA, 4321 bp, Homo sapiens
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaaatgtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatccgcccgcctcggcctcccaaagtgctgggattacaggcatgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttttgccaagacttaatgtggaagttcccttacc

SEQ ID NO: 53714 - DNA, 2014 bp, Homo sapiens
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagcctgggcgacagagcaagactccatctcaaaaagacaaaaaaaatttaccaggcataatggttgcccctgtagtctcagaattgcgggggttgaaaggggagcatcactggggcccagggtccaggcccaggagataaatggccaatgactcaccgatgaccatgaaccttcaaaaaaaggggggttaaatcc

SEQ ID NO: 53715 - DNA, 921 bp, Homo sapiens
aaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatg

SEQ ID NO: 53716 - DNA, 368 bp, Homo sapiens
caggaaacctactgtgaaaatgcagaaaaacaacagacaaaattgattgttgactcaatatgatatatagttcaaatgtaaacaaatgcttgttagcattccacatcactgaaggaaaaaaagtaagttattatttccaatgttgggagttaggttgctataagcttatgaacacacactttcagtgaatttatgtagaatcggaagcacttcattctcccctcaccacacatcacccccttgctcctcctcgacacgtgcaaaatgatagggcatggtaggggttgtagtgaaatggagaaggcatgccccatctcaagaaacaggtggaccagccacagcttcagctcattgtgtgatacaggaat

SEQ ID NO: 53717 - DNA, 1239 bp, Homo sapiens
gaacattttccctcatcctctgaaagtggaaaccagactgagatggtaagttaactgataaaacctgtcagcattccatcattttccccttttgacgtatcagtacttctaagaagggatctaagcacaattaagtgaattgagtccctggtctagcctcaggaactgaaacttctttggggcttgtcttgagacgtggcaaattctccttggtgagttttctaaaagtatttccccatggaaaggagaaagtggtttgggacagaaagaaatggaatgtcttcagtcatggaagagcctccatttcatctcatgtccatttctagcctctttcaaaaagcacagtgcatcatgagcaacagaaaagcagtagaatcctaaaggacataacagttgttccgtaactagaagcattctttgattttaaatttgaagctgttcagtttgcagctggggatatgtgcatggttgggaacttatacacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcaattgtgtgtggactctgagaagcctgcttgataacttgtcttaagttctattaaggcagttagactgagatttctaatgacttcaccataaagattatacttctgcctggcgtcgtttctataaaacactataggacatttgttttcaaaagcagttgagtaacagcaacataaaccacattttttaaaaaaatgagcacttttcattcacttgaaagcttaagtgggaaaaaggaagatgattgtcaggggaaaaacttacaaaatgctacagtgtttacaaatgccagttccaggtgattagaaaggccgttttcattatggttcagatttggaatagcttatgcaaagattgtgttcatttttatacaattctttttaactttaaattgccatctgtgttttaaacataattctgcactttggaatcagttcattagaatgataacatttatatggataaagatgcagtattccttattctgtacttgatttattatacttaccaaagctgcaactgaataaatctggtgaggtgaggccttcaaaatg

SEQ ID NO: 53718 - DNA, 315 bp, Homo sapiens
cagaaagacactcctgcctggaaatgccaaacatcttaggacaggcagctggctgacatggttagagatgattgggggaagctgctgctgagtgaggtgttcagagctccgaggcataaatcctgtattctgaggacaccactggtagaggtaatccctagggggccctttccctgacagtgtcttggctgtgcctggcttcttttgttcctttctgagctcaagtttgacacccttccccttgtatctgtgacaaataaatgccttttcagtaagctcctttccactagagttaactaacatcaatttctgtta

SEQ ID NO: 53719 - DNA, 453 bp, Homo sapiens
ctatattaatgataatgatcatattacaggttccagacccaaccctattttttttttatttggtctggggactttaaggagttctagctttcttaatttgccttattctgatttggagattcacttctgatgttggggttcaaaactttgatactttacattctactctaatttctaaaacaggcttcattctcctaaactgctgttaacatgaaaaattttaaattccatttctccaggaatggtgacctaaccttctcttgttggttcattgataggagtaaagtcatcaccaaggctgggctgctgctattggctgccacattacctgcttggttatctgcaaatgacaagacccttgtttctacatccttcctgcaggtacttagcactaacttctggctcaaaatgctttgatgccatctccctaaagaaaaaccaataacttttggt

SEQ ID NO: 53720 - DNA, 351 bp, Homo sapiens
gccgcgcccggccaggcttttttttctctaggcctgctgtggccaccaaggctggggaccagggggcctccagggacagggatcccaagttgcacgttaatacacggagccctttctgagatgcaggttctacagggaactggattccacctcttttggggagatcaacccagcagcccaaggatcccctgatggtgcctgagcacagctgtgagaagggggtatctggatccttggggtgacaggatgggagaggtggagcatgggcctgcaggctggcccccagaggccttaggtctctgctgactagctagaattctgaaaactgtgttatgtaagacgtttagcatc

SEQ ID NO: 53721 - DNA, 3565 bp, Homo sapiens
ccggtgcagcggctggcgatcggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggatgaccacaaactcagcaatagggaattggaagagaaatatggcacagacatcattatgggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtgtacttgggctgtgtgcttggtctggtggtcattttaacggggatctttgcttattaccaagaggcaaaaagcaccaacatcatgtccagcttcaataagatgatccctcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtggataactcatctctcacgggggagtctgagccccagccccgctcctctgagtttacccatgaaaaccccctggaaacaaagaacatctgcttctattccacaacgtgtctggaaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaaaccaagtctttgaccaaagctctaggacttgggcctccttatccaagataataacattgtgtaaccgagcagagttcaagccaggacaggaaaatgtccccatcatgaagaaagctgtgattggagatgcctcagaaactgctcttttaaaattctcagaggtcattttgggtgatgtgatggaaattagaaaaagaaaccgcaaagtagctgaaatcccttttaactctactaataaatttcagctctccatccacgagatggatgacccccacggcaagcgcttcctcatggtgatgaagggggcccctgagcgcattctagagaaatgcagcaccatcatgatcaacggcgaggagcacccactggacaagagcactgccaagaccttccacacagcctacatggagctgggcgggttgggcgagcgtgtgctgggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggttattatggttactggtgatcatcccatcacagccaaagctattgccaagagtgtggggatcatttcagccaacagtgaaacagtggaagacattgcacatcgcctcaacattgctgtggagcaagttaacaaacgggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattatcccctccattgccttggcgtacgagaaagctgaaagtgacatcatgaacaggaagcctcgccacaagaataaggacaggctggtgaaccagccgctcgctgtgtactcatacctgcacattggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatggacaaggtaccagagggaatacctagaatggacgggctacacggctttctttgttggcatcctagtccagcaaatagcagatctgatcatcaggaaaacccggaggaattccatcttccagcagggtctcttcagaaataaagtcatctgggtggggatcacctcacagatcatcattggtctgatcctctcctatggcctcggaagtgtcacagccttgagtttcaccatgcttagggctcagtactggtttgtggctgtgccgcacgccatcctgatctgggtgtatgatgaggtgcggaagctcttcatcaggctctaccctggaagctggtgggataagaacatgtattattaagaccacctcccttcctatgtctctcagcagcacgttggggcacacttgttcatcttctgaccgtttgctgggctattcccctgcagtgcagacatcgtcaaaattcatacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtata

SEQ ID NO: 53722 - DNA, 262 bp, Homo sapiens
tccatcttccagcagggtctcttcaggtactgcctgtgcccggcctcctggggcagccctgggcctgccgtgcaaggatgatgatgatttgtttttcacaagacagagttctggccacacttgtaaccccagaggcattgatttttctggtggcatggtctgctgggtgtatgatcatgaagccacaagaatcccaagtctgtctgcttttgtgtgtcttgcagaaataaagtcatctgggtggggatcacctcacagatca

SEQ ID NO: 53723 - DNA, 439 bp, Homo sapiens
gacgtgggcggggcgggcggcatttaaggctggtgccacctccccggtgcagcggctggcgatcggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccaggtgcgtgcagcccccgcgccggccgaggatgcgagacgctgggccaaggccccggggaccggagcaggctgacgggaagcgaggaaaaggcgaagaggagaaacgccccgtcccggggcaaggggaggccgcctttcctctgagcgccccccggcctgggcaccgcttctctgactccccgccacggctccgtgcggccg

SEQ ID NO: 53724 - DNA, 1812 bp, Homo sapiens
gtggcactcaacaggtgctctgagtggcacccacggccaggtcctgggagaggacagaaaacaactgggactcctcagcccccggcagctcccagtgcccagccacccacaacacaacccaaagccttctagacaagctcagtggaatctgaagggcccaccccatggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctgatgaggcctcttcccaatttaaacaactcaagtcagaaatcagttcactccctggaagagagagaggggtcttggcactctcttcttacttaaaccagtcccagacacctagacacggacccctttttgctgatgagtgttgggactgactcctggaagacagcctggccttgcccacctgcacacagtctgttggataggtagggccacgaggagtagccaggtaggcgagacacaaaaaggcctgggacagggtcagtacaagtcaggtcaggcttcatgcctgcatcctccagagaccacaggagccaaagcgagcctccaggcccagcaatgagggacttgggagaaatctgagaagaatgggttgttctcttgggaagtcagggtatcagatgggatggacatccaggtcttctccctgcctaattgtcaaggcctccttggctctggagctatgaaaggccccactttcaagtcacccttgccactgaggaccgaggactatgctatgatgaggattaaggtgttgacttgcctctttcagagataaatgacaagccttc

SEQ ID NO: 53725 - DNA, 398 bp, Homo sapiens
ccatgttggccaggttggtctcaaactcctgaccttgtgatctgcctgccttggtctcccagagtgctgggattacaggtgtgagccaccgtgcctggccacccccccgccgccaccctttttctttcctaggacagattctcgctatgtcgcccaggttgcagtgagccgagattgcaccactgcactccagcctgggtgacagagcaagactgtctcaaaaaaataaaataaaatagatcccagggtactcatttttcatatgagggaggctgggttcctcccagaggagcctaaaacagccaacaagagaaattgttggcggcaggaagattgcagaggaattctaatgcaattatttgggacctcaaatggaataaaatgaaagatattggtta

SEQ ID NO: 53726 - DNA, 2706 bp, Homo sapiens
gtggcactcaacaggtgctctgagtggcacccacggccaggtcctgggagaggacagaaaacaactgggactcctcagcccccggcagctcccagtgcccagccacccacaacacaacccaaagccttctagacaagctcagtggaatctgaagggcccaccccatggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctgatgaggcctcttcccaatttaaacaactcaagtcagaaatcagttcactccctggaagagagagaggggtcttggcactctcttcttacttaaaccagtcccagacacctagacacggacccctttttgctgatgagtgttgggactgactcctggaagacagcctggccttgcccacctgcacacagtctgttggataggtagggccacgaggagtagccaggtaggcgagacacaaaaaggcctgggacagggtcagtacaagtcaggtcaggcttcatgcctgcatcctccagagaccacaggagccaaagcgagcctccaggcccagcaatgagggacttgggagaaatctgagaagaatgggttgttctcttgggaagtcagggtatcagatgggatggacatccaggtcttctccctgcctaattgtcaaggcctccttggctctggagctatgaaaggccccactttcaagtcacccttgccactgaggaccgaggactatgctatgatgaggattaaggtgttgacttgcctctttcagagataaatgacaagccttcagtttggggcatcctgttgtttgggcgaggaccctctctgatattctgataatccccacctgtaacctcaggtccctggaaatacagaggaggctgggatcgcctgagacacaaaaatctttggagaattttcttgaccctctgaagtccttccagcagcagtcctggtggtgctgctggaagcaggcaatgtcctagtctaacctaactcgaagaaaaaaaggaagatattcacaaagattgtataaatctccaaactgttcccctatctgcccccaattcagctcccttgcctcctccacacccctattacatataataagcagagcaagtgggaggaggggaaatgtccttcctatatgccaggtatggggctgacatttcagtctattgaccccagctagaatatagctccatgattttaaagatctcaggggccaggcatggtagctcatgcctgtaatcccagcactttgggaggccaaggcaggtggatcacctgaggtcaggagtttgagaccagcctgaccaatatggtgaaaccctgtctctactaaaaatacaaaaattagcagggcatggtggcaggcacctgtagtcccagctactcgggaggctgagacaggagaattgcttgaaccctggaggcagaggttgcagtgagccgagattgcaccactgcactccagcctgggtgacagagcaagactgtctcaaaaaaataaaataaaatagatcccagggtactcatttttcatatgagggaggctgggttcctcccagaggagcctaaaacagccaacaagagaaattgttggcggcaggaagattgcagaggaattctaatgcaattatttgggacctcaaatggaataaaatgaaagatattggtta

SEQ ID NO: 53727 - DNA, 833 bp, Homo sapiens
gtggcactcaacaggtgctctgagtggcacccacggccaggtcctgggagaggacagaaaacaactgggactcctcagcccccggcagctcccagtgcccagccacccacaacacaaccgtgagtagctttttttgttgtttattttaggcttcttcctcattccccaacacctgtattcttttttgtttgtttgtttgtttttgagacggagttttgctctgttgaccaggctaaagtacagtggcacaatctcggctcatgcaacctctgcctcctgggttcaagcagttctcctgccttagcctcccatgtagctgggattacaggtgcccgccaccatgcccagctaatttttgtattgttagtagagatggagtttcaccatattggccaggctggtcttgaactcctgacttcaagtgatccacccaccttagcctcccaaagtgctaggattacaggtgtgagccaccactcccagcccctatgtctgctttaagtggagaagcagagcttatgagggaggagaacaagggtgcaaaagggacctagatatcactgagaactgcccttgttgtttggttgaggaaatgggcccagacagtggacaagacttgctcagggagacaaacgagatggtgtccagtgcaacaaacctaggtttcctaacttccagttctgtccactctacatcagtgcctctcacctgtccctgcaggttcacattttggttatgtggataaggagaaataaattgaagatcacaatgtcccattttatcttccccaagacaagctctgtaacattaaagaccactatgcaaaccgaaaa

SEQ ID NO: 53728 - DNA, 2667 bp, Homo sapiens
gtggcactcaacaggtgctctgagtggcacccacggccaggtcctgggagaggacagaaaacaactgggactcctcagcccccggcagctcccagtgcccagccacccacaacacaacccaaagccttctagacaagctcagtggaatctgaagggcccaccccatggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctgatgaggcctcttcccaatttaaacaactcaagtcagaaatcagttcactccctggaagagagagaggggtcttggcactctcttcttacttaaaccagtcccagacacctagacacggacccctttttgctgatgagtgttgggactgactcctggaagacagcctggccttgcccacctgcacacagtctgttggataggtagggccacgaggagtagccaggtaggcgagacacaaaaaggcctgggacagggtcagtacaagtcaggtcaggcttcatgcctgcatcctccagagaccacaggagccaaagcgagcctccaggcccagcaatgagggacttgggagaaatctgagaagaatgggttgttctcttgggaagtcagggtatcagatgggatggacatccaggtcttctccctgcctaattgtcaaggcctccttggctctggagctatgaaaggccccactttcaagtcacccttgccactgaggaccgaggactatgctatgatgaggattaaggtgttgacttgcctctttcagagataaatgacaagccttcagtttggggcatcctgttgtttgggcgaggaccctctctgatattctgataatccccacctgtaacctcaggtccctggaaatacagaggaggctgggatcgcctgagacacaaaaatctttggagaattttcttgaccctctgaagtccttccagcagcagtcctggtggtgctgctggaagcaggcaatgtcctagtctaacctaactcgaagaaaaaaaggaagatattcacaaagattgtataaatctccaaactgttcccctatctgcccccaattcagctcccttgcctcctccacacccctattacatataataagcagagcaagtgggaggaggggaaatgtccttcctatatgccaggtatggggctgacatttcagtctattgaccccagctagaatatagctccatgattttaaagatctcaggggccaggcatggtagctcatgcctgtaatcccaaagtgctaggattacaggtgtgagccaccactcccagcccctatgtctgctttaagtggagaagcagagcttatgagggaggagaacaagggtgcaaaagggacctagatatcactgagaactgcccttgttgtttggttgaggaaatgggcccagacagtggacaagacttgctcagggagacaaacgagatggtgtccagtgcaacaaacctaggtttcctaacttccagttctgtccactctacatcagtgcctctcacctgtccctgcaggttcacattttggttatgtggataaggagaaataaattgaagatcacaatgtcccattttatcttccccaagacaagctctgtaacattaaagaccactatgcaaaccgaaaa

SEQ ID NO: 53729 - DNA, 2024 bp, Homo sapiens
gtggcactcaacaggtgctctgagtggcacccacggccaggtcctgggagaggacagaaaacaactgggactcctcagcccccggcagctcccagtgcccagccacccacaacacaacccaaagccttctagacaagctcagtggaatctgaagggcccaccccatggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctgatgaggcctcttcccaatttaaacaactcaagtcagaaatcagttcactccctggaagagagagaggggtcttggcactctcttcttacttaaaccagtcccagacacctagacacggacccctttttgctgatgagtgttgggactgactcctggaagacagcctggccttgcccacctgcacacagtctgttggataggtagggccacgaggagtagccaggtaggcgagacacaaaaaggcctgggacagggtcagtacaagtcaggtcaggcttcatgcctgcatcctccagagaccacaggagccaaagcgagcctccaggcccagcaatgagggacttgggagaaatctgagaagaatgggttgttctcttgggaagtcagggtatcagatgggatggacatccaggtcttctccctgcctaattgtcaaggcctccttggctctggagctatgaaaggccccactttcaagtcacccttgccactgaggaccgaggactatgctatgatgaggattaaggtgttgacttgcctctttcagagataaatgacaagccttcagtttggggcatcctgttgtttgggcgaggaccctctctgatattctgataatccccacctgtaacctcaggtccctggaaatacagaggaggctgggatcgcctgagacacaaaaatctttgaacacccctccaaaaccaccgacaagtgccttcgctctgtttttatgccctgaattgaaggtttattttttaatatatattatctaagt

SEQ ID NO: 53730 - DNA, 2752 bp, Homo sapiens
cgttgtaagtgcacagtaagtttgctgaaagaatgaggactgctctcctcccctttctgccccacttgtaagtgaaaaaggggaagaaagagaatattgttcagttgattatgccagccagatgcagccgccgccgctccactgtcactctccaaggccagcgccacctctcactcaccgagctccagccgaaggagaagggggcaaagccttctagacaagctcagtggaatctgaagggcccaccccatggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctgatgaggcctcttcccaatttaaacaactcaagtcagaaatcagttcactccctggaagagagagaggggtcttggcactctcttcttacttaaaccagtcccagacacctagacacggacccctttttgctgatgagtgttgggactgactcctggaagacagcctggccttgcccacctgcacacagtctgttggataggtagggccacgaggagtagccaggtaggcgagacacaaaaaggcctgggacagggtcagtacaagtcaggtcaggcttcatgcctgcatcctccagagaccacaggagccaaagcgagcctccaggcccagcaatgagggacttgggagaaatctgagaagaatgggttgttctcttgggaagtcagggtatcagatgggatggacatccaggtcttctccctgcctaattgtcaaggcctccttggctctggagctatgaaaggccccactttcaagtcacccttgccactgaggaccgaggactatgctatgatgaggattaaggtgttgacttgcctctttcagagataaatgacaagccttcagtttggggcatcctgttgtttgggcgaggaccctctctgatattctgataatccccacctgtaacctcaggtccctggaaatacagaggaggctgggatcgcctgagacacaaaaatctttggagaattttcttgaccctctgaagtccttccagcagcagtcctggtggtgctgctggaagcaggcaatgtcctagtctaacctaactcgaagaaaaaaaggaagatattcacaaagattgtataaatctccaaactgttcccctatctgcccccaattcagctcccttgcctcctccacacccctattacatataataagcagagcaagtgggaggaggggaaatgtccttcctatatgccaggtatggggctgacatttcagtctattgaccccagctagaatatagctccatgattttaaagatctcaggggccaggcatggtagctcatgcctgtaatcccaaagtgctaggattacaggtgtgagccaccactcccagcccctatgtctgctttaagtggagaagcagagcttatgagggaggagaacaagggtgcaaaagggacctagatatcactgagaactgcccttgttgtttggttgaggaaatgggcccagacagtggacaagacttgctcagggagacaaacgagatggtgtccagtgcaacaaacctaggtttcctaacttccagttctgtccactctacatcagtgcctctcacctgtccctgcaggttcacattttggttatgtggataaggagaaataaattgaagatcacaatgtcccattttatcttccccaagacaagctctgtaacattaaagaccactatgcaaaccgaaaa

SEQ ID NO: 53731 - DNA, 2797 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaagctgtttggaaaacctaaaagatgttgtcacacttctgttttctttacctgtgccttataaaaatggaccaaacccttttctaaaataaaatagttctagggtggctggttattgacctatgtaggtccctaaaacctaatttctgttcaaaaaa

SEQ ID NO: 53732 - DNA, 2746 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaagctgtttggaaaacctaaaagatgttgtcacacttctgttttctttacctgtgccttataaaaatggaccaaacccttttctaaaataaaatagttctagggtg

SEQ ID NO: 53733 - DNA, 2017 bp, Homo sapiens
ccagcgctggtacggcccgcgtatttgatatgtcgaccaggcgctcgccacgcgctcggttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaag

SEQ ID NO: 53734 - DNA, 2604 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccaaaaaaaaaaacgaaaacgaaagcgggcgctcgttgtcgacgcggccgg

SEQ ID NO: 53735 - DNA, 2605 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttgtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaag

SEQ ID NO: 53736 - DNA, 2493 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagaaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaag

SEQ ID NO: 53737 - DNA, 1626 bp, Homo sapiens
gagaaaccagaaactgtgaggagaggcactcagctatatggcatgtaccagagaggccaagtatgaagaaaacatgaggcaccaccagttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaag

SEQ ID NO: 53738 - DNA, 1668 bp, Homo sapiens
ttatgaggaattccagttataactggcttctttggtggaatttgagatacactctcttctctgttaagcaaatactgcagattacaaatatttcagttccaggtatgaagaaaacatgaggcaccaccagttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaag

SEQ ID NO: 53739 - DNA, 2463 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtcccctagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaag

SEQ ID NO: 53740 - DNA, 1584 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatggtgagggcactgcggggaaggaagggcaggggtccgaaccgcgggctcgggccggagaattcggggcgttgctaaggctcggctacccttttccgcgccccagggtgcgctcaggatttaggatgcggcgggagaggagtctgactaagggaattgagaagggggcagggagtgaggagaggccaggagctgcaggccagccctgggggcaggcgctgtagggccgatgtcccggtaaagggcggaattgccggggcctggactggacgcgtgccggggagtgtgcccgcgcggcccccacaaggtgcgagtaggctgccaggtggaagggcacccgggcagatttgggacggtcacaaggcctgataatagcgctgacgctgagaagccgttgatgccgcagcgagctggccgggtagcgctgtgcgcccgcgggcggcggcctacctggaggggccagtcgtggcggcacccttcca

SEQ ID NO: 53741 - DNA, 468 bp, Homo sapiens
ttttaaaatcagtcaatgattcttgcctgagtcagttattgtgatggtggtttgaaaaaggtgcttttctaactctatcattccatccacataaatttactagttgcacctttaagttttgaattcgtagcctcatttgaatccagacctttcttggtttggggaagaattggtgggcaacttgcactgacctttatctgattaatataagatctatgtccacatgttacctttgttctatttcagaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagtaagactacaaaataagtactggttcttgtggtgtttaagggatctctgttcta

SEQ ID NO: 53742 - DNA, 2643 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaag

SEQ ID NO: 53743 - DNA, 2820 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaagtgtggcaaccttaaaaaaaaaaagggggcgtctaaattacccagagggccagttacgccccgtttgaaaaggcccagagggatatagaaggcagggggtaaaacggaaggacacgtctggctttgggaggccaccgcgggggttgggcacacaagcagcggaaagtgtgaggacgca

SEQ ID NO: 53744 - DNA, 3156 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaaggtggttcgcacggagagtcttttgggcctttggaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccaaaaaaaaaaaaaaaaaaaaaaaaaaaaaaaacaaaaaaaaaaaaacaaaaaaaaaaaaacaaaaaaaaaaaaaaaaacaacaacaaaaaaaaaaaagagagagcggagcggcgcgcaccaacaaaatctccccactctgagggaggcggccacactatctcgcacgcggacccaccgattctctgataggacaagggaggggcgcccatattagaagggaggagcggaaaataacgaacggaggaggagtcagcggcgcgtaagtgatacgcatagagagcaaagagtgggaggaaaaacgatgaggagagtagtggatacataatagagggaagacgagcacacccactggcgtgggagaggtgcagcaaacagtggtcgggcgccaccagcccagcgacagagcgaagacacgtggcaccggcgcacgcagggcgggaagaatacacgctcacgagcgaggcgggaacgatcgaacctgcgccctgcaaaccaacccgtggtgcgttcgcttcgtagagctgccagcataggaaacacagaccggttaaagacagaagagaggcgatgtgtgctgcgcacggtgttaaaccagccgag

SEQ ID NO: 53745 - DNA, 2595 bp, Homo sapiens
aaagtttaaatgttttactagccacatttaaaaagaaacacatgaagttattattatttgttttagagacggggtcttgctttgtcgtccacgctggtctccaactccttggctccctcaagcaatcctccagactaggcctcacaaagtgctgagattacaggcctgggccactgcccccggcctgaagttaattttaatatttcacctaacccaatatatccaaaatatcatttcaacatataaaaattattgagattttacctcaccagtcttagacatccagcgtgtggtttatgcatacagtacatatcaattccacactaaattttcagcatttaaagggaaatatggtcctgaaaaaaaaacaacaaaacaaaaaaacgcctgtttaaggagaaagcattccacactgcttgttttaatataattaaaattaatgtatcaattaataaatcaatagcccacgttggctagtggctgccttactgggcagaccaggtctggattgtaaatacgttcagacgttccacgcaaaagcaaagttccctgcagacgctccattaagttctgggtgcaaggaagcgcggatccttcagttctgggcgttttcaccaggtggcactcagaacaccctcacgtgacaagcgtcccacccggaagcgaaatctccccttctacagagttcctccggcgcttcctccaccccgggatacacagaacctcatctcctacggtgctgaagcctgcagcagggcaggatgggcaggagagcagagccgcggagtctgcggcgcgggtgaagagcggcgcgtaattcccgcagcaagattgttccgcgcccgcagcccctggactagcaggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagtgggacctgctctaccctccttttccaacctctggatctccttaaaacacgcctacaaaccctccagccctcagatcatgggtctagacgtgttgggatgttggctgtactcttgaagtccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactgaagtttcaatggattggccaagcagtgacacttattttcaaagactatggactacgtggcttcttccaaggtggcatcccccgagccctccgcagaactctaatggcagcaatggcgtggacggtgtatgaagagatgatggccaagatgggcctgaagtcctgaccaagagaggactgggaacgggtgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaag

SEQ ID NO: 53746 - DNA, 3873 bp, Homo sapiens
ctttggtttgcggagcggtcgggtgtattctccgccgcccccacgccctcgaggtccccgccaccgaaccagcggcggagcccgcccgcgcctcccgcggcattcccgcaccggatcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagttcaaagaacgcgtactgcagaccccaaatgaccttctggctgctggctttgaggagcacaagttcagaaacttcttcaatgctttttacagtgtggtggaactggtagagaaggacggctcagtgtccagcctgctgaaggtgttcaacgaccagagtgcctcggaccacatcgtgcagttcctgcgcctgctcacgtcggccttcatcaggaaccgagcagacttcttccggcacttcattgatgaggagatggacatcaaagacttctgcactcacgaagtagagcccatggccacggagtgtgaccacatccagatcacggcgttgtcgcaggccctgagcattgccctgcaagtggagtacgtggacgagatggataccgccctgaaccaccacgtgttccctgaggccgccaccccttccgtttacctgctctataaaacatcccactacaacatcctttatgcagccgataaacattgattaattttaggccatgcagtggaacctgtcacctaatgggactgcattctgaatggaacattccggctcttcaattttttaagcaatttagactgtagcaagaaaatgtgcagccttttgggcaaagcccctgggaacgaggcctatccactatggactatggtaacttggtaggatttttagtatttattttaatggagggacaaatgctttctaactgggcccccgactccgcaccccagttcgcagtgaggccctgggtgggtcacctgccctctctggacttgtttcttcaactggaggaggtccctgcctatgctgacattccattgtagaaaaatggggcctctggtgtctctttaccaggggcagtgcctctctgcgggggaggaaaagctcaaggttagctgtcttaacccaagtgacttaccaggcctacaaaagagtccagtccagtcacttgttggactgggctctgacagatggcctattgaggtcaacttgaatgtgagggctgcggtgtggtttcaaacattcatgatggatgtattttcctacccctaacttaaggagaaaaaaaaaaagacttcctttttttgccaaagtccagaaaggggcctttagcctttagtaggagctcaaattgttggggcccctctacctctctcagggctagaactgcctgactcttggtggacgagcccttcagggttctgctttcagccccacctggacagaggcttacaagactagggtctggaccagaatctgtgtatttctgtctgggaccaggaagctgcagctgtcccatcatccccagcaaatcctagaagtggagtctggatacttcaaggatagaagtgttggcacgcacagccatggacccagctgagcagagcagacgctttgcaggctgcccctggcttcttcctccctttcccgcttctgctctctttatggactggtcagagggtaggtgggaaagaacagacaagccatggaagttggcagtggggagatttccactgtggaaaccgcctgggaattccggccagcagcttcctccttcagccacctggccataccccttaaataagcccctcaccttgctgcctcaggaccttcaagattccatctgtgggctggccggcaagatggcaccagtggggacccacaccctggctgggcagaggtgctgctagcaacctctcttcctctataagaggaaatggaaaatgcagggtgtggaattgccctttggggtccttccttaattgaaggccaccttctcacaggtttcattctgcagggatttactggaatctattggtgctgctgcatgagtctgctgacaacctgactgcacaaggactgggtagcagactcctcagagtcctcttgacacaaatgtcagatttgtgtcactcttctgccttcgtgaaaagccaatagcactctcagatatcaggggattttagttccaagcagggaccctggtttccatactgccctcagctggagtttggatccaaaggctctggctaagtcattatgtcactttttcacaggaatgtaaatttgactgtcacctctgaatttgttcagtgtcccaccatggtctatgagaagtacactggaagcgtggggggaacacatgacatgatttgtgaatatcatcatctttgccagacaagtctccaggggatccctgtttcccaactgaaaggtgtgaacggacacacacacagcctggatgacgccttggctgttctaaggggctgtaaggtgggctctgggccttccagctaggctctcaagcacagcagaagcctcactgggctgctatgtctctgtatttgtggcttgtgtggtagcctcagaagcagagctgtttggcagactggctggagaaattccctctaggagacttgcctgtgctgtgcttccaggtcacagagccccccggaaactcacaggggccctcttcccagaaaagaatctattctatcacttcagaatcaggacactcaagctctggcagaggaaggccaagttactttcatggtcttaccctctgcttttcccctttttgcaaaaaaccactggccaaatccgaaccattgcccttgtttcccccacgttctctctcagatctttgtctcgaagggaaaacatagtggatgaaaaggtgtggcaggctttggcaccttgttaaaatttctagtcatctgtggatgttaccttgcttgtccacagcagccagtcaccctggccagtcccacttcctggataattctctaccctcaccccacagagccatctctctccagaccaaaagctggaaggagagttgctttgagagcttgtttttacaactgcatgtttattatgatactttctctccaaaggaaacttttaaatcaatgggaacaattagcaacagaaagagcacagtccctgcttttgactgggttcctattttaagcacaaatgagagctctggagccagaatgccagggttctaacttcagcattcacttactagctgtatgatcttggccaagtcacttcacctccctgagccccaattcccaagtttgtgaaatggcaacaatacctatgtgtcactggattattggttaaaacagaatgagattccttgtgtgaaaatagctattatacctgacacactcatcgtatgggctctgcaaagggatattccccaacctgtccttcccgacaggaagcatagggcactgcagatggggaagcatgtcaccttggcagtgactcggtggcttcccaagcaggagtgtcaggggaaccatgagagagagtctaggagccaaacacatcaccaccctgagcagatacaggagtggggagggggctgtaactcagtgagtggcttccaggggccccaggccctgctggatgtgggccaagccctacagcttccctaggcagtaagtaaaaacattctcctagcattaaaatggtttccataa

SEQ ID NO: 53747 - DNA, 896 bp, Homo sapiens
ggccgctcacctggtccttgtgggaggcagcccttcctccatacctcgttgctgccactaaacttgggagtgtccttgggccagggccaggcccaggcctgggtttcttgccataccccctgagggcaccaggacaggtcccagaaagggctgcgccatgagggggcctgcagtaggtgcagagagtaacaacccagcatgcgcagagcaagggcctgtggagtgggtccccaagggtaacttggtgctggcagatgcttaacagccggctgtgggcgtgcgggaggcctgatgtgtgttgtcagccgattgctgtggtgtcagtattcaatattatcatgactgagtcaagctgccctcatgaggtcactgagtagggagttggaaaagatgcaaaatcacacacgcccttgtcgtatcgtctttccaccatgcacacacacacaatgcagctcagccaccagggcccggcagggccagggtggagatgtgcacggtgcatgtggctgtgtgttgggggcaggggcgggaggttctgcggctggactagagatgaggttggtgggcgcagtgggttgagagggggacgcacagttgccaatcacagcactctcgctgtgtttccctgtaaacactcagtcttccccctctgtaggttcaaagaacgcgtactgcagaccccaaatgaccttctggctgctggctttgaggagcacaagttcagaaacttcttcaatgctgtgagttcacctggtccctccttccacactggcagagcagacaggagtgggcactggctggagcccctacacagcccacagctctgctcctcctggctggggaaggacagagggttccttcctgcttgtgggggtgtgtgggcacagggagccctc

SEQ ID NO: 53748 - DNA, 682 bp, Homo sapiens
ctttggtttgcggagcggtcgggtgtattctccgccgcccccacgccctcgaggtccccgccaccgaaccagcggcggagcccgcccgcgcctcccgcggcattcccgcaccggatcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagtgagtgccggggccccttggcctgtcagggctgtgttctctgtgctaggtcagcctcaagtctctcggaggttttcgttacactcaggctggttaacccagagaatgagctgaagagctgcctggcagaggcgtttgatgttgggggtgcccagctgcctgctgtggtgaagttgggggcagccaaggggtggaggatggaatctgtgacctcccagatgctttccagcctctgcttccaccacaggcctgggtcagcccaggtgagtcgcagggagcaggtacttcgtgacccactctgaaa

SEQ ID NO: 53749 - DNA, 4093 bp, Homo sapiens
ctttggtttgcggagcggtcgggtgtattctccgccgcccccacgccctcgaggtccccgccaccgaaccagcggcggagcccgcccgcgcctcccgcggcattcccgcaccggatcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagttcaaagaacgcgtactgcagaccccaaatgaccttctggctgctggctttgaggagcacaagttcagaaacttcttcaatgctttttacagtgtggtggaactggtagagaaggacggctcagtgtccagcctgctgaaggtgttcaacgaccagagtgcctcggaccacatcgtgcagttcctgcgcctgctcacgtcggccttcatcaggaaccgagcagacttcttccggcacttcattgatgaggagatggacatcaaagacttctgcactcacgaagtagagcccatggccacggagtgtgaccacatccagatcacggcgttgtcgcaggccctgagcattgccctgcaagtggagtacgtggacgagatggataccgccctgaaccaccacgtgttccctgaggccgccaccccttccgtttacctgctctataaaacatcccactacaacatcctttatgcagccgataaacattgattaattttaggccatgcagtggaacctgtcacctaatgggactgcattctgaatggaacattccggctcttcaattttttaagcaatttagactgtagcaagaaaatgtgcagccttttgggcaaagcccctgggaacgaggcctatccactatggactatggtaacttggtaggatttttagtatttattttaatggagggacaaatgctttctaactgggcccccgactccgcaccccagttcgcagtgaggccctgggtgggtcacctgccctctctggacttgtttcttcaactggaggaggtccctgcctatgctgacattccattgtagaaaaatggggcctctggtgtctctttaccaggggcagtgcctctctgcgggggaggaaaagctcaaggttagctgtcttaacccaagtgacttaccaggcctacaaaagagtccagtccagtcacttgttggactgggctctgacagatggcctattgaggtcaacttgaatgtgagggctgcggtgtggtttcaaacattcatgatggatgtattttcctacccctaacttaaggagaaaaaaaaaaagacttcctttttttgccaaagtccagaaaggggcctttagcctttagtaggagctcaaattgttggggcccctctacctctctcagggctagaactgcctgactcttggtggacgagcccttcagggttctgctttcagccccacctggacagaggcttacaagactagggtctggaccagaatctgtgtatttctgtctgggaccaggaagctgcagctgtcccatcatccccagcaaatcctagaagtggagtctggatacttcaaggatagaagtgttggcacgcacagccatggacccagctgagcagagcagacgctttgcaggctgcccctggcttcttcctccctttcccgcttctgctctctttatggactggtcagagggtaggtgggaaagaacagacaagccatggaagttggcagtggggagatttccactgtggaaaccgcctgggaattccggccagcagcttcctccttcagccacctggccataccccttaaataagcccctcaccttgctgcctcaggaccttcaagattccatctgtgggctggccggcaagatggcaccagtggggacccacaccctggctgggcagaggtgctgctagcaacctctcttcctctataagaggaaatggaaaatgcagggtgtggaattgccctttggggtccttccttaattgaaggccaccttctcacaggtttcattctgcagggatttactggaatctattggtgctgctgcatgagtctgctgacaacctgactgcacaaggactgggtagcagactcctcagagtcctcttgacacaaatgtcagatttgtgtcactcttctgccttcgtgaaaagccaatagcactctcagatatcaggggattttagttccaagcagggaccctggtttccatactgccctcagctggagtttggatccaaaggctctggctaagtcattatgtcactttttcacaggaatgtaaatttgactgtcacctctgaatttgttcagtgtcccaccatggtctatgagaagtacactggaagcgtggggggaacacatgacatgatttgtgaatatcatcatctttgccagacaagtctccaggggatccctgtttcccaactgaaaggtgtgaacggacacacacacagcctggatgacgccttggctgttctaaggggctgtaaggtgggctctgggccttccagctaggctctcaagcacagcagaagcctcactgggctgctatgtctctgtatttgtggcttgtgtggtagcctcagaagcagagctgtttggcagactggctggagaaattccctctaggagacttgcctgtgctgtgcttccaggtcacagagccccccggaaactcacaggggccctcttcccagaaaagaatctattctatcacttcagaatcaggacactcaagctctggcagaggaaggccaagttactttcatggtcttaccctctgcttttcccctttttgcaaaaaaccactggccaaatccgaaccattgcccttgtttcccccacgttctctctcagatctttgtctcgaagggaaaacatagtggatgaaaaggtgtggcaggctttggcaccttgttaaaatttctagtcatctgtggatgttaccttgcttgtccacagcagccagtcaccctggccagtcccacttcctggataattctctaccctcaccccacagagccatctctctccagaccaaaagctggaaggagagttgctttgagagcttgtttttacaactgcatgtttattatgatactttctctccaaaggaaacttttaaatcaatgggaacaattagcaacagaaagagcacagtccctgcttttgactgggttcctattttaagcacaaatgagagctctggagccagaatgccagggttctaacttcagcattcacttactagctgtatgatcttggccaagtcacttcacctccctgagccccaattcccaagtttgtgaaatggcaacaatacctatgtgtcactggattattggttaaaacagaatgagattccttgtgtgaaaatagctattatacctgacacactcatcgtatgggctctgcaaagggatattccccaacctgtccttcccgacaggaagcatagggcactgcagatggggaagcatgtcaccttggcagtgactcggtggcttcccaagcaggagtgtcaggggaaccatgagagagagtctaggagccaaacacatcaccaccctgagcagatacaggagtggggagggggctgtaactcagtgagtggcttccaggggccccaggccctgctggatgtgggccaagccctacagcttccctaggcagtaagtaaaaacattctcctagcattaaaatggtttccataactacttttgtcctggcttcttaatactgggtacctggcatgcagccaagaactctgcttttccgtggtgcttatgtattaagtagattagctggggagggatattccttgtttaatggcagatccaggacactccggaagctctgcccaccaacttcaccttaccaggcgagagtagcactgcttggaaggctgctcctgccttttaaagcctgtctacg

SEQ ID NO: 53750 - DNA, 352 bp, Homo sapiens
aaagtttcaagctaaatgcaaataaacaaaagaacttacagctataaatgacatcaaagattcatttaattagaaaataatagtactctcaccccaatcaagactattttggagactctgattttgtgctttcttgcttaccaggcaaagaaattggtgcaaaataattcagcttcaggaaagatctggcaagatggctgaataggaacagctccggtcgcagctcccagcgagaccaacacaggagggtgatttctgcatttccaactgaggtacccggttcatctcattaggactggtcaggcagtgggtacagcccacggagggtgagcagaagcaggttggggcatca

SEQ ID NO: 53751 - DNA, 365 bp, Homo sapiens
gtattttttaaagtttcataataaaaagacaaaagaatttctgtgacacattttgagtatcattttgtgtcttcagttaatactgaataaaaattaaaaaactaatatttatcattttgtggagcattatgggtattgccaattaaggcttaaaagtctggagtatagcaaatttacattaaccttataagcgatgttaatgagacatatacatatttttctcccaaaagattaagtttctttggaagaaaacatgtgcagtaagttttatatagtataacttaattcatgaggactttattttatttgtagatgtacaaaatgataaacttatctgcattattaatatgtccattaaaaaatta

SEQ ID NO: 53752 - DNA, 171 bp, Homo sapiens
attcttcagcttgccttgcagccagatgtggccatgtgactaagttctgatggatgtgagaagaaagatttgcaactttcaggtcttgcctttaaagtgaaaggcatcttctcttttccttcttccaaaggctaaaacagagacttgcaagcaatagctagagcaaccact

SEQ ID NO: 53753 - DNA, 874 bp, Homo sapiens
atcagcctggccaacatggtgaaaccccatctctaccaaaaaaaaaaaaaaaaacattacccgggcatggtgttatgtgcctgtagtcgcagctactcgggaggctaagtggggaagatcacttgagcccgaaacttctgcatttagtttgtatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattccctactcggtcatactggactggcttcgttctcttaacatactcagtaatgactcaagcctctggctattaacataccctagttgccattttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgcgggaataacatgtaatataatttgaaataaaggtatagtaacctta

SEQ ID NO: 53754 - DNA, 102 bp, Homo sapiens
gggaagaatcccccatccatggcagcttccatgggtggcaagtccccagcatccaagggctgcctctgagtgtcacccacccccacctgagaccttagtggc

SEQ ID NO: 53755 - DNA, 437 bp, Homo sapiens
tggtatacttttgtctttttttctacttgttagttgtattagtatcaaatggcataataaagttactttgtttgccatttcccactcatctgaaaatcacaaaaagcatttatttctaagatttatatccactgaccttttccccaaagttattttcctgttacttgtatttcatctttgcccttatttctttaatatttgtattagaattagcttgctcttgtttccttcacggcaaatgtgttacattgcccactgggtggcttctgcggatgcccctacccacccctcgtctggagcagagaagtcctgttagcctagcagcatagtggctgctgtcagtgcgaggagttgtgcttctctagcatggtctgtgatgtcatctggacataattattagactaatcgaatagaggaacaagacagccctgcctgcg

SEQ ID NO: 53756 - DNA, 326 bp, Homo sapiens
ttgatagatgctatgggcgttattttctgcttataaaatcttagaacagttatgtctttacagataagatttgatttttatcaaacggtggaaaatgctgtgactggcacggtcttcacactctctcttggaaatctgcgatcctgggtcggtttaatttaaaacattccagtaataactttcagactttacaactcaattttattttgagaagtcatcatgaaggaaatatttaagaagtctcattcctttaagtttaaaaatgttccacaggattcatttgcaacagccagccactcaccccaaccccaaacttccagaaaaaa

SEQ ID NO: 53757 - DNA, 604 bp, Homo sapiens
ttaaggcatggacaagctgaatctaaaatgtttatgacaaataatctataacagccaaataactttgaaagaacaaagttgaaagatttaaatcatatgacttcaacatttattataaagttatagtaatcaagacatgtagtaatgccaactaagatagacaaatcagagagtccagaaatagaaccacacatctatgataaatggtcaactgatttttcataaagtgaaaatgcagctcaggagaaaaagaatagttttttaaacagtgctggaccactggatacccataaacaaaaccaaaaattttaaaaactcattttggctgagtgcaatgccttatgccctgtaatcccagcactctggggaggcagaggtgggaggactgcttgaggccaggagtttgagacctgcctggtcaacatagtgaaaccccatctctacaaaagaaaaaaattagtcaggcacggttgcatgtgcctgtagtcccagctacttgggagcctgaggccaaccatcacttaagcccagcagtttggggctgcagtgagctatgatcccatcactgcactccagcctgagccacacagcaagaccttgtttc

SEQ ID NO: 53758 - DNA, 1040 bp, Homo sapiens
agttccataataagcaaatacaactttgggacagtctgagacagcgttttctgaattttttctgaccacaacccataatgagcaatacatgttataatgtgatccagtatgtgaacacatgcacactcacccaaaaaagtctgacacaacaatatttaccctttttgcatccaattcactttacaatttttcattatttttctatcctattccatttacattttgaagaaagctggtgagtagtcagctaaaatggctccacaacctactctgcaaaggagttgcaatctgcacttggaaaaacactggtctatggacagggctctggtcagtgttctcaataacagtttggagactttaagcagtaacacgacagctttcaaaaacaaaacaagggctgggcgcaatggtacgttcctgtaatcccagctattcaggaggctgacgggagaattgcttgagccttggagctggagaccagctggggcaacatagtgaaaccttgtcttaagaggaaaaaaaaatacaaaatcaggtacacaaaatgaaattctcatccaaaataaaccattctatatccttccttgaaaaaccacaccaacgctggactttgtagcacaaagacttgtaaggaggtcggggctagactagatccagatatgcctaatattcaactaggccaaaagaactgccccctcgcccgccaatgaaatgaaatgcctccaaagtgatcctctggctatgtacatccgctagcatgcaggtgggtaatgaagagagtggagacaaccagccgatttcttcctggactttctgagtttcaaagtgctttcacttctattatttcatttaatgagatgctgtcagaaagttcatttccagaactggaaagtattaggtggtagagaaaagcatttcagggccgagcacggtggcttatgcctgtaatcccagcacttttgggaagctgaggcaggagcatcacttgagtccaggggttcgagaccagcctgggcaaaataaggagaccttgtctctac

SEQ ID NO: 53759 - DNA, 122 bp, Homo sapiens
ggtctgcagagcacacagggcccaggagcagacgccagagggacagtgacatcttaggctgatggagcaatcgatcctcttctccctttatttcctttgaccttccaaatggtcttcattag

SEQ ID NO: 53760 - DNA, 368 bp, Homo sapiens
caaaacaaaaactagccaggcatggtggtacatgcctgttgtcccagctactcaagaagctgaggtggaaggaccacttgagcctgggaggtcagggctgctgggagccgtgctcccaccactgtactctagcctgggcaagagaatgagaccttgtttaagaaaaaaaagaagccacagatcccttgctgcaaggcgtagcatttttagcagaactgccaggtagagaattcaattcaactaacacacactgagcacctattaatatttttatacaaagtcctgttcacctgtatgatactggtgtctattaacaaatttgatttgttgatttatctacaaacctagatttatccagaatgcaacca

SEQ ID NO: 53761 - DNA, 245 bp, Homo sapiens
atgctaacttgtatagctaatgcatcctccctttattctcttattctttgctttttccctttccacaaatatgtattagtcttttaccaaagatcagctactgtgcccagttctgggacagagataaagcaaggcttttccgctcaggagttaattgtccaggtataggaagtaagtcagatccattattaatcataatggggctggacagtgacgggtaccatggagcatcaagaggaagagag

SEQ ID NO: 53762 - DNA, 407 bp, Homo sapiens
gagtctcgctctgtcgcccaggctggagtgcggtggcgccatcttggctccctgcaagctccgccccccgggttcacgtcattctcctgcctcagcctcccgagtagctgggactacaggcgcccgccaccacgcccggctaattttttctattttttagtagagacggggtttcaccgtgttagccaagatggtctccatctcctgacctcgtgatccacccgcctcggcctcccaaagtgctgggattacaggcgtgagccaccgcgcccggccaccagtctttctggttttgaggctcactcctgccactgagtcccatctagattgcagaaatgcaaacagacacatacagcttcagcccttcaaacaaaagatgtacctcaactccacctaacggagccaga

SEQ ID NO: 53763 - DNA, 1042 bp, Homo sapiens
tatagcatcaagttctagaggaattgggagccattgcaaatctgagggtcaggaggaatctttcgtcccacagagctcagtgcaaccaccagaaggagacagtgaaacaaaagctcctgaagaatcatcagaggatgcgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagatttaatatcagaggaacaacaataggtgatagaataatgagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgtgagcatttgatgcttctggaagctgataatcatgtggtaaactgctggagcacatccgttgtgagccaattttagcctcatctggcatagattatgacatagagatctggtcaccattagaagagtcaggatttttaaccgaaaattgctgacagagtataactcgaaagaatccatgctggagaaactagacaccccttcaggtccaggctctttactgttgacgatgttggttcacttatcaatatcg

SEQ ID NO: 53764 - DNA, 279 bp, Homo sapiens
ggaacaaggcctctgaagcggctaaatacccaaccgtctaccccccacacacaaaaaaggcggtatggttgggggaggaaaacggccagcaaaaggaaaaaacagagaaaagatttttaaattttcactgctaaagggattttatttacataacaacgccacctttttgccagccagaccaaaccgaaagagcaatggctgtatttctgaaagtagcattctgtccggccgaaatatggtaatgagatttaaaaagatttttttaaaggagctcaatgg

SEQ ID NO: 53765 - DNA, 1266 bp, Homo sapiens
  misc_feature (513)..(513): n is a, c, g, or t
  misc_feature (1251)..(1251): n is a, c, g, or t
atggatgtgctcagccctggtcagggcaacaacaccacatcaccaccggctccctttgagaccggcggcaacactactggtatctccgacgtgaccgtcagctaccaagtgatcacctctctgctgctgggcacgctcatcttctgcgcggtgctgggcaatgcgtgcgtggtggctgccatcgccttggagcgctccctgcagaacgtggccaattatcttattggctctttggcggtcaccgacctcatggtgtcggtgttggtgctgcccatggccgcgctgtatcaggtgctcaacaagtggacactgggccaggtaacctgcgacctgttcatcgccctcgacgtgctgtgctgcacctcatccatcttgcacctgtgcgccatcgcgctggacaggtactgggccatcacggaccccatcgactacgtgaacaagaggacgccccggccgcgtgcgctcatctcgctcacttggcttattggcttcctcatctctatcccgcccatnctgggctggcgcaccccggaagaccgctcggaccccgacgcatgcaccattagcaaggatcatggctacactatctattccacctttggagctttctacatcccgctgctgctcatgctggttctctatgggcgcatattccgagctgcgcgcttccgcatccgcaagacggtcaaaaaggtggagaagaccggagcggacacccgccatggagcatctcccgccccgcagcccaagaagagtgtgaatggagagtcggggagcaggaactggaggctgggcgtggagagcaaggctgggggtgctctgtgcgccaatggcgcggtgaggcaaggtgacgatggcgccgccctggaggtgatcgaggtgcaccgagtgggcaactccaaagagcacttgcctctgcccagcgaggctggtcctaccccttgtgcccccgcctctttcgagaggaaaaatgagcgcaacgccgaggcgaagcgcaagatggccctggcccgagagaggaagacagtgaagacgctgggcatcatcatgggcaccttcatcctctgctggctgcccttcttcatcgtggctcttgttctgcccttctgcgagagcagctgccacatgcccaccctgttgggcgccataatcaattggctgggctactccaactctctgcttaaccccgtcatttacgcatacttcaacaaggactttcaaaacgcgtttaagaagatcattaagtgtaanttctgccgccagtga

SEQ ID NO: 53766 - DNA, 382 bp, Homo sapiens
agtgctgaaagctagagtttcataagcacaatgcatcatgaaatcagagccaccagcaatatagagttaaaagactaaaaaacaatacaaaacaagcaacaacaacaaaaaaaaaaccaaagagataaagtgtaagttaaaaacattggatttaaaaacaaaatacgtcgcattcttagatgagagtttttaccttcttcctgccaactgatacttttaaaaaaaaattagaactttgtcagttctttcataaaagatcatttttattcatttggctgtaaaatttcctacatatgttaaaatatgtgtgaatgtgtccatttttcaaaacaagagaaaataactacattggatgaatttgcaatctatggttctgcaatac

SEQ ID NO: 53767 - DNA, 315 bp, Homo sapiens
atataatttctaaaggagatgtacttttaatataatcataggattttcagcaatattatacaccaaccttaaaaatacaagcattacctctactgaaatcagaagttttgggtcattttaccaaagattcatgagagaacataagtattctaacagaaatgggagttagtttattctaagtcactgctataccagtatctgcagagtggaattaaaaaaaaatcaaatcctatgaaactcccatagtttagggttaaagaataacataggaggctaagaagaactggtagatatttttggtaaagtagaaaatat

SEQ ID NO: 53768 - DNA, 353 bp, Homo sapiens
tcccattctttacacacctgattttgtgaattttcttgtaccaaagaattcatttttcctgctgctagtttcttaaaaattatccagcctgctagcccgaggtttgcaatgtttgcttgcatatgagagaaataaactaaagctggttaagccaagaaacgttttatccagagattattcaggtgtcttgaaacctaagagccaaaattcaattgttccaaaggaagaaactagagccaggggcctcaagcctagtgaactatttgccatctctgctccctgcttctctctgtccacctgcctcattctcgtctctgtagactggctttctttccttcacagggacatggaag

SEQ ID NO: 53769 - DNA, 356 bp, Homo sapiens
aactgggtaacttgcttttctcacttagtgaaaccacagacatgtcaacagatgcagaactaactctgcttcgcagaggcgacctgatacttcatactatggagaccctaccctcgatttgattcctttagtaatgtttattaattttgttttcagggtttttttttgcctctagaaacaatgctgccataaatatctttttttcctatatgtaacttttacacggagcttttattggtgtgggcagattcccaggaacagggttgctgggttatgggatttgtgtattgccagctcactttccagaaaaatgttgagcgactcacattccctcaccagtgtgtgagagggcctgt

SEQ ID NO: 53770 - DNA, 411 bp, Homo sapiens
ccactcgggtgctctgctgcctactgcctgagaaagttcagatgggccacttcacctctcggagccccattcttcaccctgaaattggacaacagccttccctctcagggcagcattgaaagtgaaatgaggctgggcgcggtggctcacacctgtaatttcagcactttgggaggccgaggtgggtggatcacaaggtcaggagttcgagaccagcctgtccaatatggtgaaaccctgtctctactagaaaatacaaaaattagccgggcatggtggcacacgcctgtagtcccagctacatgggaggctgaggcaggagaatcacttgaacctgggaggtggaggttgcagtgagccaagatcgcgccactgcactccagcctgggtgacagagagagactccatcta

SEQ ID NO: 53771 - DNA, 312 bp, Homo sapiens
attggagatgcctttgtcaaattttcccattttaaatggccaggaaaaacaataattatttttctgatgctgaggttttatatcttagtagaagaacttaaactatgacttgtattcaagtctaacaggaatagaggtaatgaatgaaagtagtcattgacctgggacaagatcactttgaacatgacactattatacaaagtgtaatatttatttttaaacaaccacttttcaaaagcagttgtgcatacattccaaagaataaaatgctagctactaggttttgagaagcagaataaaatatgatactga

SEQ ID NO: 53772 - DNA, 317 bp, Homo sapiens
cccatcttaataagggactaattggattaaattttaattatccagatataaagtaaaacatacagtagtgaatttgtgtaacatttattactataaaaaagataagtggttatttataaaataatgtgtgaaacttttcttgatcctgaggggtcaaaggaacaggtaatgactaataatactgataaaccgtatgtggaagactgtggtgaataaaataaaaaggccccagggatattttgttgtgcctgatttggcccaatctgttgatcaccttggcttttaatgcctctcattaggaagagtcttcagcaaag

SEQ ID NO: 53773 - DNA, 997 bp, Homo sapiens
ccagggcacagtgtatcctattgatattaataggtagtgatggcttaattatcttgataaaacagtaactccattttaatgtgggttctctagagatagagttataactaatttggaaggttacaaacaggattgcggtcaattttgggatatgagaaccctttgatatccctcaaattaaactagaggatattttgatggatatttccctctgcaatttatcatactctctcctgcaccttcaatttgtcagttactacagaatcatttacattattgtacagtctgccattttaaaataaaatggtttcttgatccagtgttctgcttcagtgactgcctcatttctttttatttatttatttttataaatagaagcgggatctcgctgtgttgcccaggctggtcttgaactcttgggctcaagcagtccacccacctcagcctcccaaagtgttaggattacaggcgtgagccacggcgtctggccctgcctcatttctctacctcaccttgaggaagcgtagttttttgacagaacaaaaaataaatacaggagtgagaaccagaaactaattagttacctacaggcaccgggtaggaactgagtaaatgggaacaacagaaggaatggccttgttctgaatgtacttttttgcatagttttgagttttggaaactgttagtcttttttatgttcaaaaataaaattaacaagatgtggagagtgggactccaaaacaatacaaacagcaacaacaaaccgtgtatttatgtgaataatataaactcccagaagaaaaaaaaaaaaaccaagtaagttttgagcacaggattaaagattaaagaactgaaaaaataatcttgaactctgtgtagtaggctattatttgtatggtagaggtgtagcaattctgaaactattttgtgtgcattataggattgagcaaatgagtaaattcattgatattttgggaactagggtttccaacgtgga

SEQ ID NO: 53774 - DNA, 1324 bp, Homo sapiens
gctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtttgtaccacaccatgcatgactcagatgccctcaggtccctttttctatggtatgtatactgcttgtgtttgggttgaagcactacctg

SEQ ID NO: 53775 - DNA, 585 bp, Homo sapiens
  misc_feature (23)..(23): n is a, c, g, or t
  misc_feature (556)..(556): n is a, c, g, or t
ctagggtggaaagcgacgtctanggtggagagcgaggagttgtcaggaaagctgcaggttactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatcgcagggcctttcagtggccttcgttttttttttttattttttaaacgtgtggtacgggactctcggtttcttccgggctcatctttccagcctcacccctttgggngtacttgactctgtccaggtcgctttcca

SEQ ID NO: 53776 - DNA, 331 bp, Homo sapiens
gaacttttgggggagttgggaggttgacttcatgggcaccttcaaccatatgtatgctcacacacggattgatggggagaaagaggttgactaagctttccaaacaaaaatgggaatacgggacccagtaaatggtctttgtccagcttctaggaggtaatgtggtgctgaaaataggaacacttctcagatatttcaatgtcttatgggagcaaagagacaatatttgaaaatgaggcctcctacgccgggtgcggtggctcacgcctgtaatcccagcactttgggaggcggaggcaggtggttcacatggtcaggagatggagcccat

SEQ ID NO: 53777 - DNA, 573 bp, Homo sapiens
atgagtaccagtgtcacagccatcctcatgtaagtggcactctgcatggcggcctcatgcagaagaaaggctactctttgaataactcgtgtattgtcatagtttttacatccttccccctcctccttaccttctcaatttcactcttctatgtcctattctttagtaatgttttttaaaaaattccctcttttcttgtctgtcttttcctgttcttaaatatgtcgtgttactggcaattatggatttctttacgactagggtcatatctgttgtgagtctttcccagtgccttgccttcctccccaccaaaaaaaaaaaaaaaaaaaaaaggctctgacttgataagaaattctttgacattttgagctgggaaacttcattcagcgggatattgccggcaggaggtctgccgcccagcttagggtgcaagcagggctggggtgtgggcgttttcctgggagctcctgatttacatcgacctcaagtatgaagccagtaaaagtgccagcgatgctgtgtctttgaggttaaaaaatctcttgtgttgatatggctaattctgggccacaa

SEQ ID NO: 53778 - DNA, 1372 bp, Homo sapiens
tatctctaagaaatatttcctcttagtttcttttcaccttgacttcaactttgatattaatattcctacacccactttgtgctagtgttttccagatatggtaagttgatcaaaaaaatgacacaataactccttcccttcctgaatccatatgccttgtgactttgcctctgttctaataagaggtgaagtccatttccttattcgttgaatcatgtttggcattgtgacttgtgaatacagaaggcagcagaactaatgctatgggacatctgagtctagtcctcaccaggtctcccagctgctgatctcatcacctggaacgctgctcccaccatgtgtagaagcctgggttagtgtcctggaggatgagagacaatgtggagggtgaggctggccaacagcctgcaccagctgtgtaagaccatctgagatgactgtagctgcatgagtgaacccaggggagacatgcagagacttgcccagctgtcttacttgttactttaagccattcagttttttctaagataaaaaaggttagtttatctaggcagaaatagtatgtaaataattatacaagtagtacatggatatgacgaaaaccttgaagctgatgtgcaaagagctgaaacttggaaaatacttaatgagagaatggcctaaagagctattcggtactctgaattccccaaaggcaaggaccaatatttatccacctccgatatctcctccggaaccttacacagtacttggaacacagtggactctctacaaataccaaattgggaattaactcttattataaatactgagtgtcagccctggttcttccgggctccaaaactaacatatgagtagatttctccaggtagacaagagtgaggtaaacccccaagaatcaggaactagagccaagtaaagaataagccccgagaagctttgagtaaaaaaggatactgtttgcacattgcgtattggaaaacaagtagaaagtccaaaaacaaaataaaaacttacagcaggaagaaaaaaaaaaaaagccccacaaactctacagcttaagttagcctaaccacagctgagatatttcttccgaaagaactaaatgacaagttgagagaaaggccccattgtcaggtcagctgttcctgagaagaactaaattcaaaactagacaaaactctctcactactaaaaacgcatatagacagggaagcattttttcaagttatactaataagttgacttggatgctttaatagctttcatgaataattctgaaaattgtttagcatatttgaggaactccacaactacttagaataaaaagaaaagcaactttttaaaatttagtagtatctcaaaaaagaaa

SEQ ID NO: 53779 - DNA, 432 bp, Homo sapiens
gaggtcatagattttggtgggtaagagtgctgcttgcttagaggggttttggcagctgccttcaggcagtgagaaactgttaaggtaggaaggagaacagacaacttcggcttagatgagaaattgtgagcactttccaacagtgacatcccagtactctgtttaagtgaaaagctgaactctcttaaaactctcttgccatgcctcatgtcatcatttctccaggattggaatgtgtgccactcctagaaaggattattggcagagtttcaatgtctctctcctgtctttcttttcctctcttcattccatgtgaatatacgaaggaaggtggctccccacccagtgctcagaggttgggtggaggcagcacacagacaggtagtgacccttcaagcatggggaggccagagttcagaggacggtgtgtgg

SEQ ID NO: 53780 - DNA, 448 bp, Homo sapiens
cccctaggattccagataagacaatgcacagaagtatacattataaaccatttgaaaatggcttctgatgagctacttttccccagtaggaacagagtatctcctcatgagatttcaagtggttactgggtgtttggctatgataatgcattaatgtgtataattatagtttttgcactttctcggtatgttttacccttttgaagaatttaaaaatacaagccattagccaggagaactatacgcaatgcatattttcaacaaagtaacaatctccagaaaaactcctatgcctctgtaagaaaaatacaaatcattgaggaggaaaggggccagaaacataaacagatatttcacaggtgaataagcataagtactaataaatgtaaaatatctaaactgtattaataataaaaaagtcagaattatgactataatgacatataat

SEQ ID NO: 53781 - DNA, 429 bp, Homo sapiens
atgtgaggcccagcccttctagcctggggtgttgatggaagtagaagggaggatgtgtgcttagtttactcaggagccatgctgggggcattgtgggattatcttaatccccatgacaacactctttaaagtagatctgtctctattttattttcttaaagacaaggtctcactctgttgcccaggctgaagtgcagtaacaccttcttagctcactgcagccttgaacccttgggcccaagcaattctctcgcctcgtcctcctgagtagctaagactacaggtgtacaccaccacgctcggctaatttttgttattaaatttttttgtagagaccggggggtctcactatatttcccaggctggtcttgaactcctggcctcaagtgatcttcacaccttggcctcccaaagtgctgagattacagg

SEQ ID NO: 53782 - DNA, 606 bp, Homo sapiens
atcagttctcttgtgacacagagaagaagagcagggagaaaggccaggaatggatcttgacagcagacaggcctggaccggcagccttgtcttgaaggaataaacctgagaaaggatagtggctctagagaaacagtaatagcacctttctagcacctttgatttttctcagtccacctttctctaggaaaagacttgtttggaaggctctcattgatacctgggcagatcagtgtagaagagggtttagtgtacttggggagttgtcaccttcccttggtttcccagtgaaccatgctagcggagcacttgaaggagcagtcacttagagccgagagagcattacacactcagccacgctgcccatggcacctgtgggatctctgtccctgagggttaccaggagctgtcattggggggtatacatattgataaacatgctgtgccttaaagcagctgtacagtactagagaaagcctcgatctgtcaggcacgtcaggcctgagtgcctccttgttgatgactggcccggtcccttttgaaccacttctacttcctgccatagaaagacaagcataatttcttcatagccagaaaaaaaaggaa

SEQ ID NO: 53783 - DNA, 769 bp, Homo sapiens
aagcagtggtatcaacgcagactggtcattatggccggttgattaaaagacggaattttgactcgtgtctgtatcatacaagtacaaatactaattttgccctatgtatccgtaaatgtcatttgtgattttgacttatttatttaatgccctttcttatgccgtgggttttcaagtttactcatttctatggttgcaaataactctaaaacttattatataaactttcatattataggcagaacacaatggctaaatatctgttgcatgtactttaaagtttattataaaatataaacagatatataaagatgttgactcttacctgtgattttgcatggtcagactcggtgtcaggtacggagaggattctcatgactgtcttacctctactgaatattctagtgagttatatgatttacggagtgattaacagaggtctatataaagttacttttcccctttacttaattatattgtagtgtgcagataacaaaactgctaccttctcatccaagtggtctgtagaattcatgtcccttacagtggtcatttaaagtcaatatttatttatgtatgtaataaaaaaagttggatttttgtgtatgtctgtcacattatttagagagaagtaatcttgtaaaaatgttttgtaaaaaacaaaaaagtattgtaaatagtcttgatattctgtgactcattattttcatgttagagtttgtacatactggttcaataataaagtatccttaaaccagaaaaaaaagtc

SEQ ID NO: 53784 - DNA, 1771 bp, Homo sapiens
  misc_feature (62)..(62): n is a, c, g, or t
gggtcggcgaggagggtccggccggagttgaaggattgaactttccggctcagtcgcggcgnctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctccgtgcgcctccaggtgcctgagcctgcagatcactcgcatctccgccttcttccagcacttccagaacaatggttccctggtttggtgccagaatcacaagcaatgttctaagtgcctggagccctgcaaggaatcaggggacctgaggaaacaccagtgccaaagcttttgtgagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaaggtgtccccctgaagcccagaaaagagttacgatttacagaactgcagtctggacagctggaggttaagtggtcctcgaaattcaatatttctattgagcctgtgatctatgtggtacaaagaagatggaattatggaatccatcctagcgaagatgacgccactcactggcagacagtggcccagaccacagacgagcgagttcaactgactgacataagacccagccgatggtaccagtttcgagtggctgctgtgaatgtgcatggaactcgaggcttcactgcccccagcaaacacttccgttcttccaaagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatgggtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacaacagaactacaggaaacagtggaagcagaaatgaccaacatggagttggggaatgagagtcacatcatccctcatgaagtcctgaagagtgagcgatctgcaggcccacaaggaatggacatcattccacacaaacgcagcagcgtggatgagtgtagagagttagagaagcgcattgcatgggcagagaactcagcgtgaggaaagaatgaaggtggatgggccactggtctctcccctggaggtctcattgagttgcaaggatttaaccaccatctgtgtgctaatgactccctgccctcccaccctgaccactctttgaactccagagtcctgcattcagccacccacttagcacctccccttggatggcttgcagatatttcaaataaaacgttcaaacacaaaaaaa

SEQ ID NO: 53785 - DNA, 417 bp, Homo sapiens
tcctaacagtgcccaatctgagaccatctactctttaccgactggaagtgcaagtgctgaccccaggaggggaggggccggccaccatcaagacgttccggacgccggagctcccaccctcttcagcacacagtgagtggggtgccagggcattaagccatcctgtcaggtcttgtggacatagagaaaaatcttgctggaaaatgaaaacaaataaatacactagtacaggtttctatgagatagggaaattgtcatcatctgaaattctttctccctgtttgtaccgacttactagattctattccaggcacctgtagtatacattgcatagttgatgcttaattgttctttttctccctccctccctcttccccgcttttctccctttctttgctccttccttgtttcctttct

SEQ ID NO: 53786 - DNA, 6327 bp, Homo sapiens
  misc_feature (62)..(62): n is a, c, g, or t
gggtcggcgaggagggtccggccggagttgaaggattgaactttccggctcagtcgcggcgnctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctccgtgcgcctccaggtgcctgagcctgcagatcactcgcatctccgccttcttccagcacttccagaacaatggttccctggtttggtgccagaatcacaagcaatgttctaagtgcctggagccctgcaaggaatcaggggacctgaggaaacaccagtgccaaagcttttgtgagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaaggtgtccccctgaagcccagaaaagagttacgatttacagaactgcagtctggacagctggaggttaagtggtcctcgaaattcaatatttctattgagcctgtgatctatgtggtacaaagaagatggaattatggaatccatcctagcgaagatgacgccactcactggcagacagtggcccagaccacagacgagcgagttcaactgactgacataagacccagccgatggtaccagtttcgagtggctgctgtgaatgtgcatggaactcgaggcttcactgcccccagcaaacacttccgttcttccaaagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatgggtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacaaagaacagcttgtgaaaactagaaaaggtggaattcaaacacaactcccttttcaaagacgacgacccactcgcccgctggaagtcggagctcccttctatcaggatggccaactgcaagttaaagtctactggaagaagacagaagatcccactgtcaaccgatatcatgtgcggtggtttcctgaagcgtgtgcccacaacagaacaaccggatcagaggcatcatctggcatgacccacgaaaattacataattcttcaagatctgtcattttcctgcaagtataaggtgactgtccaaccaatacggccaaaaagtcactccaaggcagaagctgttttcttcactactccaccatgctctgctcttaaggggaagagccacaagcctattggctgcctgggcgaagcaggtcatgttctttctaaggtgctagctaagcctgagaacctttctgcttcattcatcgtccaggatgtgaacatcaccggtcacttttcttggaagatggccaaggccaatctctatcagcccatgactgggtttcaagtgacttgggctgaggtcactacggaaagcagacagaacagcctacccaacagcattatttcacagtcccagattctgccttccgatcattatgtcctaacagtgcccaatctgagaccatctactctttaccgactggaagtgcaagtgctgaccccaggaggggaggggccggccaccatcaagacgttccggacgccggagctcccaccctcttcagcacacagatctcatcttaagcatcgtcatccacatcattacaagccttctccagaaagatactaaactgttcaaaaagattttgtgaaattgcacagatgtgtaagcttgttgaacttcggccacgagacatgcacacttccagaggcagtgggaactgctcagaggcccggactctcctatgtgactttagtgcaggaagaacttctgtcaatcatggacgcatctggagacaagtgagaaacagtagattggtgaagacagacaccagttccctacaagcatggagaaaatgaagaataggcctgtttaatgctaaattttgttttcatgtatggtgtcgctcatttctattgaattacaacagaactcagttttccctgaatttggagcaccaaactccgccccaaaaaggagagtaacaaatacacaattcacacataacactaagcgtaaatctaatcaataaaatatatttttgactaaattattgattcgatatgaaaaatcaactaagattacacagctttgtttttttgaatctttcctaagatcatttttatcctaggtgatttttaaatgaaaatgtgtaatctaaaatataccagcgaatttaaatctaaaaatgctcctactttaagtaccttgtgctgctctttatgcaaaggtaaatcaaagttccctctataaattatgatttacaaaagacacccaagccagaggaactcaatgaaataagctgctaatcagattttaccttggagaaatgaaaattatttcttggggatgccttttaatatttgatcctattatgtgagagattttcctgatatgttatcttatttatattttcccttattttcctcaatgcagataatagcttttggtgcacttttgtttcaccatctgaaaattcacaaaacttcttgcttcaaatgaaaaaatcccaactattgagcatgtttaaatctttgcagagatttgccttttcttaatcaaagaaaggtctttgtgtgctagaatattattggtaatgttttaaaaattcctttgattgatagagaaggacagttatttgcatttaattcacccatatgctttcaaatctagtatatcttactttttggaaatgttttatgctacaaattagtgccttgtagcatgaacttaagtcaaaacgtgttatcaatatagagtgttgcagtgtatattgtaacaacctaaaacgcagagaagtttaatttaatactgttttttttcttgaaggaatactcacatacatggtttgaaatgtgcatagatatgcatgtctatataattataaatgcatgtgtatatatatgcaaatatatgtacatatacatgtatatacacacagacacatgcatatacatgaatataccttgagcatgaatccctggagaaatcgttttcgtaggctcaccaatggtgagtaaagatacagctcttttaaaggtcataaggataatatattttccccatcaatgctgattctgagaaaagagcaatttatcaaaattaaacactgtaaaagaaaggtgtccatatgtctttacctacctaagtaaaacaggaagaaaatcagtaacattatccttaggttttgacaatggtacttgcttcttgttgttttattgtttcctgaattcatgcagatgcctggccattcctgggaagagtggataactcagaagtcactgtactccacagagcctcactgcagtgtctaaaggtagatgcaaattaaaatgcagggaaaataacttttctgatgttgatgcatgtctttgggaaacacatttataaacatggatacctgataatagatattgaaacccatttcctgtgtgttaaaatatttaaaaagtggatattccaggaatgttttgcagctttgtacaagtaacataaattggacacctcagaatgaaagttcatgttggttctgaatggttcactgcagctcctgtcacaagctgggatggatttatcacattgagttatgaaattacctggttctaagaatttttgagtggcaaaaatagaaaacaatcttcatttgaaaacatccctaagcttgaataaatggataccatagatagcttctcttttttattctggtgtcattaccagcatctgaatttcaagttcttaaaatttcaaaaattaaaatttttcattattagctatccatttatcttttacatgaacttgtcatgaacaaattcaaatgtttatgccagcaaatttttgtactgttgcatagttaaaaatgctgggagtctctgcatagatacaaaatattattaaattattacataaatttaattttataaaatttaatcatgcttcttttgtctgggtaatagacattggacagatatttttagttcagatggtgattctgaagcttacatctcccttaaaaaaatctaaagcagctcttatgggcttctaattttaatataaataaataatttaaattttattggtgttattggaagaaaaatgctattaatgggctaataaaaaacatgtgtttctcttatggattttaataagctccagtattattcaaatgatcaaaaatatagttataattttttgaattttaaaaatgtgattgctctaataaagaataaaatctatgctttttaacaaacatagttttggtgcctaattctgtaatatgttttattgaaattagattcatttctctaatgtgagaaaaatatatccagtaatagtattgactgtttaaaaaattgagctcatcaaaaatattgtcatcaaatacaggtggttaatctgacatacattgcagttacatgcattatttttatttacaacatttgctccttaatgatgaatttatctgtgttaccctgtttttctacctggaactccatagaatgatgtttgcaaaccaacatgtgctcttttcagtcattcactgttttaatatgacatggtagagaagataaggtttatggcaggtaattttttgtaatgtgtattaaacgaagttcaaagattagaaatacatctgtgtcctgaaaaccttagatacatagccgactgtatacagaggttcatctcaacctcaacactattgacttttggggctggatagttctctgttgtgggggtttgtcttgtgcactgtaggtttttagtagcatccacactttctcctcaccagatgccagttgcaccctcccccaagttgagacaaccaaaaatgtctccagatattgccagctaccccttgagggatggtacctctggttgagaaccattgctagagaatgatctttactgaatttgccctttataagaaacccagtgaatttctagagcaagtcccaaaaactaagggacagctaagaagttattatggttgacttcaaaggcctaaactgtgttttttatgtccactaaacaacttgattaaaagacggaattttgactcgtgtctgtatcatacaagtacaaatactaattttgccctatgtatccgtaaatgtcatttgtgattttgacttatttatttaatgccctttcttatgccgtgggttttcaagtttactcatttctatggttgcaaataactctaaaacttattatataaactttcatattataggcagaacacaatggctaaatatctgttgcatgtactttaaagtttattataaaatataaacagatatataaagatgttgactcttacctgtgattttgcatggtcagactcggtgtcaggtacggagaggattctcatgactgtcttacctctactgaatattctagtgagttatatgatttacggagtgattaacagaggtctatataaagttacttttcccctttacttaattatattgtagtgtgcagataacaaaactgctaccttctcatccaagtggtctgtagaattcatgtcccttacagtggtcatttaaagtcaatatttatttatgtatgtaataaaaaaagttggatttttgtgtatgtctgtcacattatttagagagaagtaatcttgtaaaaatgttttgtaaaaaacaaaaaagtattgtaaatagtcttgatattctgtgactcattattttcatgttagagtttgtacatactggttcaataataaagtatccttaaaccagaaaaaaaagtc

SEQ ID NO: 53787 - DNA, 2404 bp, Homo sapiens
  misc_feature (62)..(62): n is a, c, g, or t
gggtcggcgaggagggtccggccggagttgaaggattgaactttccggctcagtcgcggcgnctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctccgtgcgcctccaggtgcctgagcctgcagatcactcgcatctccgccttcttccagcacttccagaacaatggttccctggtttggtgccagaatcacaagcaatgttctaagtgcctggagccctgcaaggaatcaggggacctgaggaaacaccagtgccaaagcttttgtgagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaaggtgtccccctgaagcccagaaaagagttacgatttacagaactgcagtctggacagctggaggttaagtggtcctcgaaattcaatatttctattgagcctgtgatctatgtggtacaaagaagatggaattatggaatccatcctagcgaagatgacgccactcactggcagacagtggcccagaccacagacgagcgagttcaactgactgacataagacccagccgatggtaccagtttcgagtggctgctgtgaatgtgcatggaactcgaggcttcactgcccccagcaaacacttccgttcttccaaagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatgggtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacaaagaacagcttgtgaaaactagaaaaggtggaattcaaacacaactcccttttcaaagacgacgacccactcgcccgctggaagtcggagctcccttctatcaggatggccaactgcaagttaaagtctactggaagaagacagaagatcccactgtcaaccgatatcatgtgcggtggtttcctgaagcgtgtgcccacaacagaacaaccggatcagaggcatcatctggcatgacccacgaaaattacataattcttcaagatctgtcattttcctgcaagtataaggtgactgtccaaccaatacggccaaaaagtcactccaaggcagaagctgttttcttcactactccaccatgctctgctcttaaggggaagagccacaagcctattggctgcctgggcgaagcaggtcatgttctttctaaggtgctagctaagcctgagaacctttctgcttcattcatcgtccaggatgtgaacatcaccggtcacttttcttggaagatggccaaggccaatctctatcagcccatgactgggtttcaagtgacttgggctgaggtcactacggaaagcagacagaacagcctacccaacagcattatttcacagtcccagattctgccttccgtaggtcccacctcttgtactatgtctgtgtcattggtatctactgctcctttttactgaccttcagaggtggctacctctgtcattctgtgtgctgcactattgagtcttatttttgcattttcttcttctgagtgtatcttttgcaagcattaacacatcacaaatgtgactgcatagctaagaagtagcataagctgccatctagataaagtttgatggctagagccaactcatgaaaagaccttaccctatcttgtatataagtgattgagccattttcttctatctttgttaacctcatgtctctctggtccaagtgaacatgccctgtttgaagtgttgaattgggaagggcaggaatagctaaaagaagcttgttgtttgtccgtcttccccgcaacttcaaa

SEQ ID NO: 53788 - DNA, 454 bp, Homo sapiens
tggacccccgcacacaggtacttccacagcaccggagtccactcagcccacaagcaccgcccaggcacctctgcgcgtggctagaaaaggttgatgacactccatggggctgcactgtcttctagaaggtcctcagcccacatgtgccaagaaaggccaggatcctccagaaactacctgtgccccagcctggacgtctgtctggcgcagcagctcttctcagtcagcacagccccagtccctggttccatgatggaaacagctccctaatccatgtgagactgaagtgtgactacatgtgtctgcaggagagcctgtgggtgacctgtatgtgcgcacgtgtgagggtgttgctggtggttgtggggagagacacaaaataacctggaaacccctgaatcccccacaggagctgagattagaggtaacaattctcaagagaaaccctgagttc

SEQ ID NO: 53789 - DNA, 308 bp, Homo sapiens
atcactgccttaggcttttttttctttttttaaaccatgatcctcttgcaaaccaaacatacaatcgtctcagaacctctccatataaggaatttccagacagactgattctatgcaatatttcttgggcttaatggagaaagtcattctagggcattgtccagctttctgagtcatgccatcagggtactgagaggctggctcacccaggacaaggcctggcctttctgagcctcaggaaagccatgagtgagaaaggtcactccgaggctactgatccctaagcaatgcatttatgatttcaagag

SEQ ID NO: 53790 - DNA, 262 bp, Homo sapiens
tgacacggtaaggcccgaggaggcctgaggcactctctgaagggcgtggatagagaagagtgacatttgcacaatccttctctttttctaatgtgtgtttccctttctagaaggcagggatcttgtctgtcctatttatccttgtgcccatggtatcttgcacctggtaggcattctgtaaatcaggggtccccaagccctgggctgcagacctgtttggaactgggctgcgtagcaggaggtgagcggtggccaccgtgca

SEQ ID NO: 53791 - DNA, 391 bp, Homo sapiens
  misc_feature (384)..(384): n is a, c, g, or t
cctgtacttcggatccagggtttttgacagaagaggaagaagggggaggggtagaagtgttaaggggagtctgctgagaaaagctgtttttgaagccagaaggggtttttgtttttataatgccatttgacagagtggaataacagtatctaaggaaacgggtagaggacaacaaagaatggagcatattcatggcgaggagcaaaagctctaccccattgaaaggcttcttttcctccctggcgacaaggacacatgcattggtggccaaaagagagaggagacaaaaccgctgcagatggctgatgtgaatctagtggaaagagctactggggatgagagaaagaggaggaggcaggtaatgcagagcgtgaatggtgcagntggttgg

SEQ ID NO: 53792 - DNA, 349 bp, Homo sapiens
acgggacttgctcctccttgccttccaccatgattgtgaggcttccccagtcacatggaactgtaagtccaattaaacctctttctttataaattgcccagttttgggtatgtctttatctgcagcgtgaaaatggactaatacgttaagttgataccagtagagtggggtgcttctgaaaagatacctgaaaatgtttttctcaaaagatcaatatcattttatattttaattgattttaaaaagctttcctctaggttgtctctggacagttttaaaaatgactaaggctaatgggtgttccctcacttacatgagagaaataaaccaggaattttggtttatgaat

SEQ ID NO: 53793 - DNA, 299 bp, Homo sapiens
cagagtgagaccctgttacacacgcacatacacacacacacacacacaaatctatagtctagaggaagttataaggcacataggtgtaatgcttataattgataggaagtgatgagtatgaaagcaggttgacagataaagtgctctttgtttctagagaaagaaatcacttctgttctaggatattagggaaggcctcagtgaggaggatgataattttgctatatgttcagcagccattttcagatgagatcaggcacgttcagggtggcatggccatagacacagcagccattgtc

SEQ ID NO: 53794 - DNA, 451 bp, Homo sapiens
gctgccatggcgatgagctcccttccccggtaatagaatggagtagagtggatagggaaagacctgcacctgtgagggccccccagagaccacctccccgcccccttcccaggcaaatgggaaagcccagccatccttgagatagaccacagtgcctggcagcagagggtggtgggcttccctgagtgtgcctggattcttgagtgcctttctgcatgtgagggcagttctatgtactgtgagctggtgtgtgtctaggtatagacctgctagcaagtagattattcagtgtctgaaagagactgagtagcacttgtgagtgagaagcaggtgtcagttattctaacagataacaggaggtggaacgtgcacacgatatgcaggcatgtgtctttgtgagcccacagaattcttgtgtgtagaatatacgggtgcatgtccacatgaaaaa

SEQ ID NO: 53795 - DNA, 107 bp, Homo sapiens
ggactgggggggaggatcgcttgaaaccagcaggttgcggttacagtgagctgtgttgttcacaccactgcactctagcctgggccacagagtgagactctatcgtt

SEQ ID NO: 53796 - DNA, 434 bp, Homo sapiens
ggaggcttccagttgtggcaaatgccaaatgtaggagatttatgctaacacccagtaaagctgctgctgcctctgcagaggcccgctgagagcaggatatttatcgtcgtcaagagtgatgacttaggagtcacacagacctggattcaaatctcaactaggcacttaaaagctgtgtgacctcagggaaatcacttaatgtctctgagtctcagctttgccttctctaaagcaaagataatgcactaggtgacacctgagtcccttctaggtcctagagtctatagggaggaatcttctcttttccttctcaaacaggcttcagaaaacaaagctgttaggataattaaatgttaagaaaatagctgcccacctccaaggactcttcacttctgctagaaagacatcaaatgctcttctttgctagactaaga

SEQ ID NO: 53797 - DNA, 321 bp, Homo sapiens
gagacattcctggttttcctcttaagtttttagttaaactttcttattcttccttatggtttcctcttcctctacctttcccttaaatctgcatctcaggtaattgattttaaaagtaccaagttatgacatggacacagagaggggaacaacacacaccagggcctcctgggggtggtgggggaagacgggaaggaacttaagagtatgggtcagtaggtgcagcaaaccaccatggcatatgtatacctgtgtaacaaacctgtatgttctgcacatgtatcccattattttttagaagaaataaaaaaataaaaaagt

SEQ ID NO: 53798 - DNA, 430 bp, Homo sapiens
tggagaaacagtgacctcgcctgtggaatgggagggatagggatgaggggtaaactgttcacagaccgctttagttgttgtggagcttggagcttagcaaggggctggtacaaaaacacaaatcaacgcaatgcaataaattgtgaaagaattgtcttctaggagggacctctgttctcctgcaaatggcagatgagaggagtcacaggttttctctcctcttaattattcagatcttggcacctgaggagcagaccagctggggttaggaatccaaagcagggcaggatccgtccacacactcgtgtgtttatttatttatgcagctccagcaaagaaaattaaaaacagggctggcccctggctgggagatggagcctgacactgcatatgcgtctgtgagactcagtctggtcccggatgcccgact

SEQ ID NO: 53799 - DNA, 2817 bp, Homo sapiens
  misc_feature (286)..(287): n is a, c, g, or t
ggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgnnggggctcagccccaaggacggagacttcgattcgggaccagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtgccccacatcctctcctccgggacagtcaccgaaaacacaggttccaaagtctacctggtgcctgagagcccagggcccttcctccgttttaagggggaagcaacatttggaggggacggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatgaaaacacaacttaattatgagtaacttaatactcgatacacaacctctaggctaaggttttcattaacctgaatttgaattctgcccg

SEQ ID NO: 53800 - DNA, 2205 bp, Homo sapiens
  misc_feature (286)..(287): n is a, c, g, or t
ggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgnnggggctcagccccaaggacggagacttcgattcgggaccagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtgccccacatcctctcctccgggacagtcaccgaaaacacaggttccaaagtctacctggtgcctgagagcccagggcccttcctccgttttaagggggaagcaacatttggaggtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatga

SEQ ID NO: 53801 - DNA, 2879 bp, Homo sapiens
gcagggaggtgacgaggtaggggcagagcggatggaagccggagatcccaggttcccggaatactccggctggggccttcgggcttctcctgtcccctccctacccccgtgcctcgggtttctccctccgtccacaccgcccggggctactggactgagcggcgcccaggcagtcccgggggcccttctcctgctccccacccggccacactcctggagacctaacttccgcgcgcgagtttcccacgctgcgcccttgcagtgcgcgcctgggaaggggctgcccggggccaccctgccggcaggggcgggagccgtgcgggctccgtgaggcgcctggatcggagcgcgggcccaggagagggcccccggggcagtgggtgccccagtcgctcggcgaaggcaggggagccggggcgggccgggcgcgctggagggttccgggcactcaacgcgctcgcgccttcctctccgcagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtgccccacatcctctcctccgggacagtcaccgaaaacacaggttccaaagtctacctggtgcctgagagcccagggcccttcctccgttttaagggggaagcaacatttggaggggacggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatga

SEQ ID NO: 53802 - DNA, 2849 bp, Homo sapiens
gcagggaggtgacgaggtaggggcagagcggatggaagccggagatcccaggttcccggaatactccggctggggccttcgggcttctcctgtcccctccctacccccgtgcctcgggtttctccctccgtccacaccgcccggggctactggactgagcggcgcccaggcagtcccgggggcccttctcctgctccccacccggccacactcctggagacctaacttccgcgcgcgagtttcccacgctgcgcccttgcagtgcgcgcctgggaaggggctgcccggggccaccctgccggcaggggcgggagccgtgcgggctccgtgaggcgcctggatcggagcgcgggcccaggagagggcccccggggcagtgggtgccccagtcgctcggcgaaggcaggggagccggggcgggccgggcgcgctggagggttccgggcactcaacgcgctcgcgccttcctctccgcagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacacgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtgccccacatcctctcctccgggacagtcaccgaaaacacaggttccaaagtctacctggtgcctgagagcccagggcccttcctccgttttaagggggaagcaacatttggaggggacggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatga

SEQ ID NO: 53803 - DNA, 2730 bp, Homo sapiens
  misc_feature (286)..(287): n is a, c, g, or t
ggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgnnggggctcagccccaaggacggagacttcgattcgggaccagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtgccccacatcctctcctccgggacagtcaccgaaaacacaggttccaaagtctacctggtgcctgagagcccagggcccttcctccgttttaagggggaagcaacatttggaggggacggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatga

SEQ ID NO: 53804 - DNA, 2530 bp, Homo sapiens
  misc_feature (286)..(287): n is a, c, g, or t
ggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgnnggggctcagccccaaggacggagacttcgattcgggaccagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtgccccacatcctctcctccgggacagtcaccgaaaacacaggttccaaagtctacctggtgcctgagagcccagggcccttcctccgttttaagggggaagcaacatttggaggggacggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacacgcttttgcccttgcactcgcccccggctatgtggcccgcgccaaccttcccccactccccgtattcttgctcagcactggcctcgcccgggcttacctgctctgcgtgctcacctctctgccccttggccccctctcggtccccccccctccgctctctgccct

SEQ ID NO: 53805 - DNA, 367 bp, Homo sapiens
  misc_feature (75)..(75): n is a, c, g, or t
ttctgtaaagacagtctcatcctgttgcccaggccggtctccaattcctgggctcaagtgatccccctacctcantctcccaaagcaccgcacaaaaaaacccacaactccctagattcgggaaaaaggagtaaattaagttggaaagccagaaaaccacgccttgctaagtcggggggatatggcacaggttaacaaacgcctcctaccaaactaaggttccactaaaggtctgggaataagggcaaagagatgtatagccttatcgcgaccgcaagggtggggccttgcagtgggaaacaaaatagaaggcaagctatcccgagaggtttaagggggctgaggactcggctctcgggagatcgcc

SEQ ID NO: 53806 - DNA, 319 bp, Homo sapiens
tagttctgactgcccagaaggttgaaactttgttaaatgaaattgagaacctgctctatactacccactctgctaaggaccaggatataggaatacatcagttggccgggcgtggtggctcatgcctgtaatcccagcactttgggaggctgaggcaggcagatcacgaggtcaggagatcgagaccatcctggctaacattgtgaaacctcgtctctactaaaaatacaaaacattagccggacgtcgtggtgggcgcctgtagttccagctactcaggaggctgaggcaggagaatggtgtgaacccgggaggcgga

SEQ ID NO: 53807 - DNA, 2512 bp, Homo sapiens
  misc_feature (1475)..(1475): n is a, c, g, or t
  misc_feature (1946)..(1946): n is a, c, g, or t
  misc_feature (2451)..(2451): n is a, c, g, or t
tgagatgggggttcccactctgttgccctggctggagtgcagtggcgctgatcacggctcactgcagcctcgtctgcccaagctctagagattctcctacctcagtctcctgagtagctgggaccacaggcatgcaccaccatgtccagctaattggttaactttttctttgcagaaatggggtcttactgtgttgcctaagctgatctcaaactcctaacctcaagtgatcctcccaccttggccctgcaaaattctgggattacaaacatgagccattgtgcccagctgagggctggtttctagaaatggtggtatgccaggcttcatactggggtcatgcatgtggactgggctcattggcctgattgctctagcaatatgtggggtagggagaatcatgccccctctctcctcctcttcgaaaaatgtccacatcccaatccctggaagctgtgaatatgttcagttatatggcagttgggaattaaggttgcgagtcagctgtccttgagatggggagattatcctggactatccaggtgggacttttgtaatcgcaaaggtcctcggaagtgaagaaggaagtcaggagagtcagtgtcagagtgatgccgtgggacacagtcttcagggctgttgctgccttgaagatgcaggaaggggccgtgagccaaggaatgcaggtggcctctagaagctggaaaaggcaagaaaatggattctccttgagagcctccagcagaaatgaggccctgccaacaccttgacttgtagcccagtgagacccaaacatctaacatctaaaactataaataagaatttgtgttgttttaagtcaccacgtacatagtcatttgttacagcaagctatagcaaacaatccaaatggagacctgtctctggtttggaaatgcgagacattcttatttatttgtggaatataatataatggaaaatttatggaatataagtaactccaagaagattcttgtcaacattaattctgagatttttctaagctaatttattttactacagtaaggccaggaactttattgctttgctgttgtctcctcactgcctcgatcagtgcctaattcattcctttttgaatgaatgaatcttttctaaccaaactcatgaaaaaccctaagaaacaccccccactttttttgagacagaatctcattttgtcacccaggctggagtgcagtggatcacagctcactgcagcctcaacctcccaagttcaagtgatcctccccacttggcttcccaagtagctgggaccacaggtgcacaccaccacgtctggctaattttttaatttttttttgtagaaatcaggtcttgctatgttgcctagactggtctcaaactcctgggctcaagtgaacctcccgccttggccttccaaaatgctctcattacaggtgtgatccactgtgcttggccccaccttttcaaaaaanaatttatgctaaattgtaaatgttaaattgaggctcttgttatagacaaggcatatcatacttcgcattatcattcaaagatgagaggcttaattagagaattttctacagttgggttttaacaagagccattcttaacttccttggggtctaagaacttcttggtacctacacatggttgaaatgttaaccctgtactttgctgcttagcaagactgctgtaatgctgatatggtttggctctgtgcccccacccaaatctcatctcgaaattgtaatccccacacatcgagggagggacctgatgggagatgattggatcatggaggcggtttcccccatgctgttctcgtgatagtgagttctcgcgatagtgagttctcgcaagatctgatggtttaaaagtgtttggcagttcccccctagctctctctctctctctctctctctcccccctaatgccatgtaagncgtgccttgcttcccctttgccttccgccatgattttaagtttcctggggcctcccacactatgcagaactgtgagtcaattaaccctcttttcttataaagaactacctgagactgggtaattcataaagaaaataggcttaattggctgatggatcttcaggtcatataggaagcatggttgcagaggcctcaggaaacttacaatcatggcagaaggtgaatgggaagcagacacagcctgcatggctgaagcaggaggaagagagagaagggggaggtgctacacacttttaaacaaccagatctcatgagaactcaccatcacaagaacagcaagggggaagtttgcccccacgatccaatcacttcccaccaggcctgtcctccaacattgggggttataattcaacatgagattggggcaagaacacaaatccaaaccatatcaggctgggcacagggactcatgcctgtaatcctggcactttgggaggccaaagcngaggattgtttgagtccaggagtttgagaccagcttggtcaacatagcgagaacgactcag

SEQ ID NO: 53808 - DNA, 967 bp, Homo sapiens
  misc_feature (906)..(906): n is a, c, g, or t
ctcagcttcaaaacgtattacaaaactacagtaattaagatagtgtggtactggtattctattctattctatagaatagaattgagtctagaaataaactcatacattatttgtggtcaattaattttcagtaaatcagtggaaacaatacaaaacaatgccaaaacaattcaatggggaaaaataatctcttcaacaaattgtactggggaaactgtatatccatctgccaaagaaaagctggactcctacctcatatcataaacaaaaattaactcaaaattaataagaggcttaaaggtaagccttaaaactctcagaaaaagcatagatacaaatttaatggccttggattggatttttttaagatatgataccaaaaggacaagtgacaaaataaaaatagataaatgtatcaaaattagaaaactttgtgcagcaaaggacaatatcaagaaagtgaaaagggctatgcattagtccattctcgcattgctataaagaactacctgagactgggtaattcataaagaaaataggcttaattggctgatggatcttcaggtcatataggaagcatggttgcagaggcctcaggaaacttacaatcatggcagaaggtgaatgggaagcagacacagcctgcatggctgaagcaggaggaagagagagaagggggaggtgctacacacttttaaacaaccagatctcatgagaactcaccatcacaagaacagcaagggggaagtttgcccccacgatccaatcacttcccaccaggcctgtcctccaacattgggggttataattcaacatgagattggggcaagaacacaaatccaaaccatatcaggctgggcacagggactcatgcctgtaatcctggcactttgggaggccaaagcngaggattgtttgagtccaggagtttgagaccagcttggtcaacatagcgagaacgactcag

SEQ ID NO: 53809 - DNA, 638 bp, Homo sapiens
  misc_feature (1)..(3): n is a, c, g, or t
  misc_feature (5)..(5): n is a, c, g, or t
  misc_feature (8)..(8): n is a, c, g, or t
nnntnttnttcttactatataaacttaaattgttttttattaaatctaggtgtaaagactttatgcaaagctcttatacaaccataaatttaaatgcaaatacaactacaaaccagtaacacctcttatattaacaatgttaatttaaccaattctttttatgtgacatttttgcagactttccccaaaacagatctactgcttgacagtgaatctcagggaagtggagttttccttcctgaactggatgagcctgagtactgcaatgctcagaacactgctctgtgggaactgcatgctctgcgggtaagagtggccctggtttttttctttttggggatgtttgtgaataattgttttccagtttttcttcaaatagttgttattgccagagtacttaattatattttgttctggggctgccttttttagaattcctgtgttagtatgctacattttactttgctgttactattctttaagctgttgaggtacattttctaaggaagcagaaaacagtgtcagttctgtagggtgcagttgtggaagatttactgaaacctttccctttattgaaatctttccctaacactcttcagaggatttgttatcaggtacatttctgttgagtcttatcc

SEQ ID NO: 53810 - DNA, 522 bp, Homo sapiens
attgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattggtgagttgctgtaaatggttattgctgtcctc

SEQ ID NO: 53811 - DNA, 3581 bp, Homo sapiens
ttttcccctgcagtgagcctgttcatgcgaagaaacggaagcatgaacgcattatagataaatatgaaaaaataccaagaactctgcaaactgcaccagagaaggaactgattcatttacttcctatcaaagataaaagtggtataatcccacagactagggagaagccagttactgatagtaacaaagatgaagaggatcaagaagaagagagggaacttgaggaagagatcattgaagatcctattcaagagctgaccatagaagaacatttgattgagagaaagaagaaattacaggagaagaagatgcatattgcagccttggcatctgccatattatcagatccagaaaataatattaaaaaattgaaagaattacgttctatgttgatggaacaagatcctgatgtggctgttactgttcgaaagctggtaattgtttctctgatggagttatttaaagatattactccttcatataaaatccggcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattgatatctgaaatgtgttgtgaagctgtgaagaaactctttaagcaagataaattaggccaagcttctcttggtgtaattaaagtgatttctggttttgtgaagggcagaaattacgaagttaggccagagatgttaaaaacatttttatgcctaagaatcaaggaagtagaagtgaaaaaagatacagaagacattaataaaccaaaaaaatttatgactttcaaagaaaagagaaaatctctatcaagaatgcagagaaagtggaagaaagcagaagagaaactagcgcgagagcttcgagaggcagaagcttcagagagtactgagaaaaaacttaaactgcacacagagactctgaatattgtgtttgtaacctacttcagaatattgaagaaggcccagaggtcacctctcctgccagcagttctagaaggtcttgccaagtttgctcaccttataaatgtggaattttttgatgatctgttagtagttcttcatactctcattgagtctggtgacctaagctatcaagaaagtcttcactgtgtccagactgcttttcatattctttctggacaaggtgatgttctgaatattgatccattgaaattctacacacatctctacaaaacactgttcaaattacatgcaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatactttccccaaaacagatctactgcttgacagtgaatctcagggaagtggagttttccttcctgaactggatgagcctgagtactgcaatgctcagaacactgctctgtgggaactgcatgctctgcggaggcattatcatcccatagtgcagagatttgcagcccacctgatcgctggagcaccttctgaaggctctggagcactcaaaccagagttgagtcgaagatctgctactgaactttttgaggcatatagcatggcagaaatgacattcaatcctcctgttgaatcttcaaaccccaaaataaagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgcttcctattcttgtgatatgataattttttgaaaaaagcacagcagtccaactaaagagatctcttactgtttgaaagtcatagcagccagttattttactctggagcttagagttcttttttcacatgaagtaaacgaaagtagaaaattcctttaccattccagcagagtgagaggatatgagcttaacagtgtatgtcagtcttttagcatattatatatgatttttaaaagtggttctgaggtcacattttttaaggcttgattatttaatgagaaaggtatgattcagcatatgaatatttgcttttagtccaccttttaggtataaaacaaagtccaggaatgtgataaatatttgtgtggataacgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggg

SEQ ID NO: 53812 - DNA, 3011 bp, Homo sapiens
ttttcccctgcagtgagcctgttcatgcgaagaaacggaagcatgaacgcattatagataaatatgaaaaaataccaagaactctgcaaactgcaccagagaaggaactgattcatttacttcctatcaaagataaaagtggtataatcccacagactagggagaagccagttactgatagtaacaaagatgaagaggatcaagaagaagagagggaacttgaggaagagatcattgaagatcctattcaagagctgaccatagaagaacatttgattgagagaaagaagaaattacaggagaagaagatgcatattgcagccttggcatctgccatattatcagatccagaaaataatattaaaaaattgaaagaattacgttctatgttgatggaacaagatcctgatgtggctgttactgttcgaaagctggtaattgtttctctgatggagttatttaaagatattactccttcatataaaatccggcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattgatatctgaaatgtgttgtgaagctgtgaagaaactctttaagcaagataaattaggccaagcttctcttggtgtaattaaagtgatttctggttttgtgaagggcagaaattacgaagttaggccagagatgttaaaaacatttttatgcctaagaatcaaggaagtagaagtgaaaaaagatacagaagacattaataaaccaaaaaaatttatgactttcaaagaaaagagaaaatctctatcaagaatgcagagaaagtggaagaaagcagaagagaaactagcgcgagagcttcgagaggcagaagcttcagagagtactgagaaaaaacttaaactgcacacagagactctgaatattgtgtttgtaacctacttcagaatattgaagaaggcccagaggtcacctctcctgccagcagttctagaaggtcttgccaagtttgctcaccttataaatgtggaattttttgatgatctgttagtagttcttcatactctcattgagtctggtgacctaagctatcaagaaagtcttcactgtgtccagactgcttttcatattctttctggacaaggtgatgttctgaatattgatccattgaaattctacacacatctctacaaaacactgttcaaattacatgcaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatactttccccaaaacagatctactgcttgacagtgaatctcagggaagtggagttttccttcctgaactggatgagcctgagtactgcaatgctcagaacactgctctgtgggaactgcatgctctgcggaggcattatcatcccatagtgcagagatttgcagcccacctgatcgctggagcaccttctgaaggctctggagcactcaaaccagagttgagtcgaagatctgctactgaactttttgaggcatatagcatggcagaaatgacattcaatcctcctgttgaatcttcaaaccccaaaataaagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgc

SEQ ID NO: 53813 - DNA, 2133 bp, Homo sapiens
  misc_feature (1)..(3): n is a, c, g, or t
  misc_feature (5)..(5): n is a, c, g, or t
  misc_feature (8)..(8): n is a, c, g, or t
nnntnttnttcttactatataaacttaaattgttttttattaaatctaggtgtaaagactttatgcaaagctcttatacaaccataaatttaaatgcaaatacaactacaaaccagtaacacctcttatattaacaatgttaatttaaccaattctttttatgtgacatttttgcagactttccccaaaacagatctactgcttgacagtgaatctcagggaagtggagttttccttcctgaactggatgagcctgagtactgcaatgctcagaacactgctctgtgggaactgcatgctctgcggaggcattatcatcccatagtgcagagatttgcagcccacctgatcgctggagcaccttctgaaggctctggagcactcaaaccagagttgagtcgaagatctgctactgaactttttgaggcatatagcatggcagaaatgacattcaatcctcctgttgaatcttcaaaccccaaaataaagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgcttcctattcttgtgatatgataattttttgaaaaaagcacagcagtccaactaaagagatctcttactgtttgaaagtcatagcagccagttattttactctggagcttagagttcttttttcacatgaagtaaacgaaagtagaaaattcctttaccattccagcagagtgagaggatatgagcttaacagtgtatgtcagtcttttagcatattatatatgatttttaaaagtggttctgaggtcacattttttaaggcttgattatttaatgagaaaggtatgattcagcatatgaatatttgcttttagtccaccttttaggtataaaacaaagtccaggaatgtgataaatatttgtgtggataacgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggg

SEQ ID NO: 53814 - DNA, 2086 bp, Homo sapiens
ttttcccctgcagtgagcctgttcatgcgaagaaacggaagcatgaacgcattatagataaatatgaaaaaataccaagaactctgcaaactgcaccagagaaggaactgattcatttacttcctatcaaagataaaagtggtataatcccacagactagggagaagccagttactgatagtaacaaagatgaagaggatcaagaagaagagagggaacttgaggaagagatcattgaagatcctattcaagagctgaccatagaagaacatttgattgagagaaagaagaaattacaggagaagaagatgcatattgcagccttggcatctgccatattatcagatccagaaaataatattaaaaaattgaaagaattacgttctatgttgatggaacaagatcctgatgtggctgttactgttcgaaagctggtaattgtttctctgatggagttatttaaagatattactccttcatataaaatccggcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattgatatctgaaatgtgttgtgaagctgtgaagaaactctttaagcaagataaattaggccaagcttctcttggtgtaattaaagtgatttctggttttgtgaagggcagaaattacgaagttaggccagagatgttaaaaacatttttatgcctaagaatcaaggaagtagaagtgaaaaaagatacagaagacattaataaaccaaaaaaatttatgactttcaaagaaaagagaaaatctctatcaagaatgcagagaaagtggaagaaagcagaagagaaactagcgcgagagcttcgagaggcagaagcttcagagagtactgagaaaaaacttaaactgcacacagagactctgaatattgtgtttgtaacctacttcagaatattgaagaaggcccagaggtcacctctcctgccagcagttctagaaggtcttgccaagtttgctcaccttataaatgtggaattttttgatgatctgttagtagttcttcatactctcattgagtctggtgacctaagctatcaagaaagtcttcactgtgtccagactgcttttcatattctttctggacaaggtgatgttctgaatattgatccattgaaattctacacacatctctacaaaacactgttcaaattacatgcaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatactttccccaaaacagatctactgcttgacagtgaatctcagggaagtggagttttccttcctgaactggatgagcctgagtactgcaatgctcagaacactgctctgtgggaactgcatgctctgcgggtaagagtggccctggtttttttctttttggggatgtttgtgaataattgttttccagtttttcttcaaatagttgttattgccagagtacttaattatattttgttctggggctgccttttttagaattcctgtgttagtatgctacattttactttgctgttactattctttaagctgttgaggtacattttctaaggaagcagaaaacagtgtcagttctgtagggtgcagttgtggaagatttactgaaacctttccctttattgaaatctttccctaacactcttcagaggatttgttatcaggtacatttctgttgagtcttatcc

SEQ ID NO: 53815 - DNA, 430 bp, Homo sapiens
agaatgaatcattctctgagtataatctaattatttttgagttacacagatgtggtggtatctttacattttttgtgtttgtgatttagatctgctactgaactttttgaggcatatagcatggcagaaatgacattcaatcctcctgttgaatcttcaaaccccaaaataaaggtatgggatatttttcatttttttaaaggaagaaatagaaaccaatgtatctcaataactctaactccagtttgcttaattattttataggtagttttttttttaatgtttaggatttcatcataggatggatttctgaggttgaaattctatagagatgatcatgaaactgttcgttcaatataggatatgtccaagaccttaccaagcatctgtcattgtgttgcatgtgttggtgtcagctgttgccattttc

SEQ ID NO: 53816 - DNA, 145 bp, Homo sapiens
gtacaatgcttaccaggagccaagagcgaacgggtggctgcgtgcaaatgctagaggttaacccctgtccatgggcatttaccgcatgagtaaaaatttattgcagagttcaggactgtgattctgcaataaattttttgagcgt

SEQ ID NO: 53817 - DNA, 1333 bp, Homo sapiens
  misc_feature (85)..(85): n is a, c, g, or t
ctgtggtccccgctactcggggggctggggccggaggatcccttgcccccaggaggcggagggtgccggtgagcctgggttctcncaccctgcactcccggctcgtggggcccacagagcaaaactccatctcaaaaaaaaaaaaaaaaaaaatttagaatgtgttagagaaatttaacaagtagaacaggtgatttctggttgatagactctatcttgcagtatatttatttcatgtatcagaccccaaagttgttgccttgttatttttttaatttctcacatttttgaaaaatagatgctatcctctatagtaaaatattgaatcactttatagtagacaatacatatgacatttaacaaatacttggtttgaaaaagtttggctttattcaacaattttagtttgcccactgattttcaaatgtctgtgggattgcttataactaagtagaaagtgaagactgatttttacttaagaatgggatagagatgagttttatggtttttaaaagtattttcagttcattatttaaatgttgggttgttgatatggtcttgtttctgataaggaaataggagcaacttgttttaaaataactacactaaaagactttcttcatctccgtatagagaaatccagatttcaattaattcatttattgggtgctaacaaaattcagggttagagtaaatttaggtctgttggtccatgtggcctggtttcctagcacccattaaacataatgctatcttttaagcctgaacatgtgggttttttaaatcaaattggaaaaaaattagacaactgatgtcatgctgtcttggtatccatactaaaaaagtatcaggaaaatagattatttttgtgctgtgaaacactattcagtggaaagtttagtggcaacttttccatatcattcatgacttaatacctgaaatgcacttttaaatgtttgccttatatccaagtgtttacttgtatccatgacctaaccgtctattgaaaagaatgtttgcagatgcagattgcaatgttgtttgtattcataggcaaaagtcctcttctctagtataattttttaaatctgagagaattgaaggtacagaaaaaaattctggagtgcctgaaccacagtttgagagcacaaaggtcacattctttcagtaaatttgggggaaataaatttcagctacctggttagcttcagtgactacttacacacagggctttggttccattacttgtttccaccacagccacatcctaaatacttggaatatccgaaaacaacttctaaaatcactcaataaaagtattcacttctaacca

SEQ ID NO: 53818 - DNA, 728 bp, Homo sapiens
  misc_feature (85)..(85): n is a, c, g, or t
ctgtggtccccgctactcggggggctggggccggaggatcccttgcccccaggaggcggagggtgccggtgagcctgggttctcncaccctgcactcccggctcgtggggcccacagagcaaaactccatctcaaaaaaaaaaaaaaaaaaaatttagaatgtgttagagaaatttaacaagtagaacaggtgatttctggttgatagactctatcttgcagtatatttatttcatgtatcagaccccaaagttgttgccttgttatttttttaatttctcacatttttgaaaaatagatgctatcctctatagtaaaatattgaatcactttatagtagacaatacatatgacatttaacaaatacttggtttgaaaaagtttggctttattcaacaattttagtttgcccactgattttcaaatgtctgtgggattgcttataactaagtagaaagtgaagactgatttttacttaagaatgggatagagatgagttttatggtttttaaaagtattttcagttcattatttaaatgttgggttgttgatatggtcttgtttctgataaggaaataggagcaacttgttttaaaataactacactaaaagactttcttcatctctctcgcttttgatctttctatatcttcttattcctctcttcgttaccttccctcattcatttctcctctatatcttcttctattctccctttccatatctca

SEQ ID NO: 53819 - DNA, 1580 bp, Homo sapiens
  misc_feature (85)..(85): n is a, c, g, or t
ctgtggtccccgctactcggggggctggggccggaggatcccttgcccccaggaggcggagggtgccggtgagcctgggttctcncaccctgcactcccggctcgtggggcccacagagcaaaactccatctcaaaaaaaaaaaaaaaaaaaatttagaatgtgttagagaaatttaacaagtagaacaggtgatttctggttgatagactctatcttgcagtatatttatttcatgtatcagaccccaaagttgttgccttgttatttttttaatttctcacatttttgaaaaatagatgctatcctctatagtaaaatattgaatcactttatagtagacaatacatatgacatttaacaaatacttggtttgaaaaagtttggctttattcaacaattttagtttgcccactgattttcaaatgtctgtgggattgcttataactaagtagaaagtgaagactgatttttacttaagaatgggatagagatgagttttatggtttttaaaagtattttcagttcattatttaaatgttgggttgttgatatggtcttgtttctgataaggaaataggagcaacttgttttaaaataactacactaaaagactttcttcatctccgtatagagaaatccagatttcaattaattcatttattgggtgctaacaaaattcagggttagagtaaatttaggtctgttggtccatgtggcctggtttcctagcacccattaaacataatgctatcttttaagcctgaacatgtgggttttttaaatcaaattggaaaaaaattagacaactgatgtcatgctgtcttggtatccatactaaaaaagtatcaggaaaatagattatttttgtgctgtgaaacactattcagtggaaagtttagtggcaacttttccatatcattcatgacttaatacctgaaatgcacttttaaatgtttgccttatatccaagtgtttacttgtatccatgacctaaccgtctattgaaaagaatgtttgcagatgcagattgcaatgttgtttgtattcataggcaaaagtcctcttctctagtataattttttaaatctgagagaattgaaggtacagaaaaaaattctggagtgcctgaaccacagtttgagagcacaaaggtcacattctttcagtaaatttgggggaaataaatttcagctacctggttagcttcagtgactacttacacacagggctttggttccattacttgtttccaccacagccacatcctaaatacttggaatatccgaaaacaacttctaaaatcactcaataaaagtattcacttctaaccaactcctcctcctttatacctgctctgtgttagggcgtagtctgtttccacctctgtaagtcctatctaggcttcctgatctatcaattcagtatcatgattgttaacccaaacgacttcctggaaaattcccagccctagatgtatccaagccctcctaccctcaccagttatttctggagaaagatcaccaaatgtataaatccgtattagtaaaaattggttttaactgacctcagcactgccca

SEQ ID NO: 53820 - DNA, 955 bp, Homo sapiens
aaataaggacagcagcagactgctgtgaagctgatctgggactgaggaggaggtcagactagagataaagattcagacctattggcaatcccaacaagtaaaagctggcagagaggaaggaacagcagcaaatgcagcagcagtggtaaacaagctaggagggaaaaaaggagggcccaggtcacagaagcccagagagggcagaggttcaatgggagactggtcaaatgttgtggagaagttggaaacctcgggtatggaaggaggctattgcatttgacaataattccgaccttttctaaagcggttttggtacagctgccttatgagagtgggtatattgtgcagtactaattagcatctccatccttagatgtcaaataactacattggaagtaggattcagaacattaattatttattaaaagctaataaggggattcaagtctattaggtttagtcattgcaaatataaagcaatatataaaggtatgcaactaattacctctgtaatttcaaatcattaaagatgcaggattaaaaaaaaaaaaaagaaacgctgagaattaagagtcatgtagtgttggcttccaccccaatatgagcaggcacagtggttcaaagcaagcactctagaataaacacacatgggttcaagtccagctattaccttacttggtgggtattcatgggtaagttaacttttccaagtctgattgtaaataataaatacacatgaaaactctcagcatagtgcttaccacataactttctcaataaatgttgacttactgttataataaacttattagcataacaatgccttgtatccaagttaaaattatatgaacttagttacgtgtaatttcaaacattcattctttaattttttatgagctccacactctaaccaactgagctaactggccacatgattctttattcttttttaaat

SEQ ID NO: 53821 - DNA, 426 bp, Homo sapiens
cgaaacattcagaatgttgacaaaatatctgggtatcatggaacagccaagctgacacataaaactaataatcacgagcaggtattgttatccttatttataaagatgtggaaaccgtgaatcttcaaggtcaagatgactcttccaaggttacacagttattaagagctgctttcagtgtactttctgccacatacagctgtctcgtaaaatctatgatttctagtattacaatgtttaatttttttaaattgatctatactagagaaacttctccatgggataaccaagacatgttgggaattcctcatgattttctttttgtcttctggacacttattctctgagtgtcgtacaattcaattcaattctgacactacccagaattagtgaagacccacaaatgaaggacttagtcccataaga

SEQ ID NO: 53822 - DNA, 334 bp, Homo sapiens
ccagccacacacaattgtaggcaaatttattgagaacttcaccatgaatacacaagctcacacacacacacacacacacaggtttgttccagtcacacacacatttcacctcagttctatgaacctaaatttccagttttctgcgcctaccccaatatctacttttactctattaagttttgtcaacacttacaagactctcctggttttcttagaactcagatatcctaatattagattttcaaaataaaacaaaattcaccaagattgtgactaagtagtagttatccacattcagaggatgaactggtccacaaatatctaactcatcccc

SEQ ID NO: 53823 - DNA, 363 bp, Homo sapiens
ttcagtcttcatcacccctctagcatgcatacctctcactcaacccaggtatctagagacacatgcttctaagctgactcaggaggcagacttgcttgactcctggggcacttttgagagggggcgttctcttcctttccatgtgccctgaggactggcaggggacagctataaattcaaattgtggttccagtgcttattagctgtgtggccttgagcaagtacagcatcactttcatcatctgtagtgttgaggtggttttgactaccctatagcattgttatggtgaataaatgcaataatacaggtaaggtactgagcagtaccatgcacagagtagctcttccatcagtgatcagtcc

SEQ ID NO: 53824 - DNA, 330 bp, Homo sapiens
ctggatgtgacatgtcccaagcttacagctggacacttgacctccttactttgatggcctcctgtgtcctgggggcagtgactgcatattttttatgaggggctgtggctgtgccctaagatgtaggacactcagcaggacagcagagacaggaaaacaaactaggtgatgaaggtcaacatgccacatcatccggcctctagggctttggaagagtcggggagagactggagggaggacccaagagggctcggggctaatacagcagaaacctcaagtgcctctgcaacagcctgggaagaagcagcctgatccaactccctgtagtcc

SEQ ID NO: 53825 - DNA, 612 bp, Homo sapiens
gagaggttaggggaaagagggatgaaagaagaaagttcttcatcaagaattgactgcagtattgcctgctgatgcatgtcggatcacccgcacagagagatcacatggcttctccaaaagtcaaacgatcaattcgcctcgttttggctctgtacttaatgcacaaacagtgcgatctgcggggctgtaattgcattgttagggccaaggaacaaggctgtgccttttcagcagacagctggcagggagagaggcatgttgttaggaaagagagaggcaaggcaaataaaattactgctaacgctcagagatcggcaggagtcctacttgcctaatcttaccggtgggagcaagcggctgttgtaatccaattatagcagcataagcaatttgttagacactccgcataatgtaacaatttcccaataaactctgacttgtaataacgtcggcaagagtccgcataaatctgcccgaatggtgggggctggagcattcggctgggggcttgtaattggcgccatcagcacgttttgcggagtgcagtatggtgcagtcttttagtgcaggaattttaaggagaaaagcgtggcacatttctcagggaaaaaa

SEQ ID NO: 53826 - DNA, 533 bp, Homo sapiens
actctgttgcagacactggtaactaatagtctacataaaaggaatggagaagaaaggacaaatggaagactcattgtggatgtcaattacacaaggtaaggtggcaaggtagaagtcaagaagtagttgaagatgctgagctgcaaggtcttacgcctggcttactagaacaacagtgccagtaatagaaaatgcgtaccaacatttgttgactgcttactcgatgccaggaacagtcagtccattaaattcgaaacacacacatcaggaagaaatagatgcagtgtaatgaaatctagacatgttgagcttaagatttaatgagatgtgtaaatgaagatagctggaaaccaagatttggaggttgggagaaaggttaaaactatatctagatttgggagtaatttctacagaaataagttgacaatatcttaagttcctgaaatctctcatattcttccaatatccaattatgtcaaaagaaatgttaacaaacacaactggttatctgctcccttgtgtttagtggtgag

SEQ ID NO: 53827 - DNA, 199 bp, Homo sapiens
ccacaactagcttacagcagagacaaatgaaacaaacaggaaaaaagatagaaaaaatacaacaaaaccaacagttggtattctgagaagatgaacaaaattagcaaatctttagctgcaataactaaaatggagagaagactgaaatagctaaaattagaaataaaagagaagacattcaactgatgtcatagaaata

SEQ ID NO: 53828 - DNA, 567 bp, Homo sapiens
ctcatagaataagtctaattcctcttttggctacagctattttttttaatgctgtgcacattttatagtcctttactgttcagacttggaaagctaggatgaaataaatatttactaaacacccctccccctgcaaaaaagaaaaagtaataatattcttaaataaggaaggggcataggctgagagctggggcatggctgtgagcacatccagtacacatattttggttaaagtacaaggacatagaatgtactacatgcctgtgagcatgtctagcacaagtattttggttaaagtgtaaggacatcgatgtacttactcctttatatctaacagctacataggatagggcttaacaaagagttattagcacaaagcaaggaggcttgaaggaagttagtctttaaaagaaattattatttctaacacttatggtttattctttaataagaagggaaatttgaagaggaactttttactttctacattcccctttaattcatggcacagttgggactacttattttcatatgaggacattcaataaacagactttactaatgaat

SEQ ID NO: 53829 - DNA, 579 bp, Homo sapiens
ggctgctcttcctcctccctgctgttcctcacccacccggcctcagccactccattcctggatgcccatgtcccagtggcggctggctggtcatccagaggcgaatgcggaacatggtgtctgagctactaacctcccaccttgggtatgcccttgaacttttctgtaagccaggctttccaacccccaacagcactcaggtcacattcccagagagcctgcacaagagggctgagtctgtttatttttcaagatttcaaaaaacatgccttttccccctctgaccttaagcaaaacttttttttccctccaacacttgtatttttaacttcatgagaaaatatggtaaaagggagcagattttattttcagaaactgtgatttttcaagatttttttttatttaaaaaagaaaggctttgggggatggggagaataaagatttttgttttgttttgttttgggtgctaagggggcccagagccacttctctgtggcccctgctcaaactcctccagagattctggcatgttgaggctgcagctcttttggttattgtgatcaaggatttctgggcacc

SEQ ID NO: 53830 - DNA, 2168 bp, Homo sapiens
caatgaatggggagtaaatacacagataatccaaaattgatgtaagcattggaaggggaaagagggaacgcttctttccctctgggcttggtcatttcctcccaagcaaaccccgcgacgttcagccgtcttcctcctatgccacgtgctctcaccagaactgcagcaaaactgcattttatgtcctgtgtctaaagctaaacacatgttcctgtctacttttgctttgttcctgtttcccttctgtgaggaccttcccctcctcagatgtggggagttgccgcctccacttgcattacatgtatttcagagtaggtcctaggctccccttacacctctggtcacgttgccattattcctatggtagataaaggggatgagaaagaacagagctccaggcctttttcaaacaaactggttttctcagtatagccctatgctcaaaaggagtgaggacaggtatgtgactgccataaggagctgtttgctttgcacagagaaatctaatctttctcctgctgggcagctcagtacagatgtcccctcactgctggaagaaacacctgcccttgcttgttctcctgatggcccctcacagtcaggtgtgggatggcacatttctaggtgctcctcgccgagctgtcatgggcttcagtcttgggcctctgcagctggctgtgaccaggtggaaactgtagccttggctgacccagagaaggaaaggaggcagtctgccgcttggctgatttaggagttgtgctgaattcctgcccatctgttctcccagctgagccaaggccaaagctgtctaccttttgccaacctaaggaatgacacagagcatggagcaccatcactgaaacatctgccccagtgccctgccaccttcgtcctcactgacctctgcagcctctctcatctgccaattttgattccgcaaggagaggtggccctgggctcacagctggtgtttgtccacagatgttcatgggtttctttgtgttctctcattttttcaaagctgggtgttgggaccaacatcaccactgacattctgtggctctaaacaagtcctcacgaccacttctcagttttctcatctttatgaagtatggagtaatccccactagccttatagagggactgtgtgagaagggaagagactgctattgtttgccctatatccacctacttccctagttccagaacgctggactttaatgagataacaaagtacctagtaaaaacactgcatcattttccatcccccaccccttgcagtaaaatgtggcccatgagacagaagcactaactactgagcaggacttctaggggagttctttaaaactcagaggagcaccacttttaccttctgctcttccctttttcctgcctggaacgcagaagtgatggctgaagctcctgaggctataagctctgtacgtaggagagtggtgaagaaaggagcttggttctgcaaggatgttgtagagctgccataccagtcctgcatggtattcctgtgcactactgttacgtgaacacacaaacacctaatttgtttaagccattaggccaggcctctattagccattcctgactgatacagaagacaaaaatggcatcacagactcctgaactccaaagacactgcctattctttcgtctgttcttggcaagcaccaacattgagactgtacttcagggttgatgctggccatttggtggcgtgaggagtgggcactcacatgtctctgctagcagttctgacgtgtccattccacactggatccatagaacgagggaacacaagtgtcttctcataagatttatagaaacagtgatcgttgcagaaaaataattagcaagagaacagacttcagctctctgaaggctgatgaccacctgtttctcatctcttctagtgtatgtcaaagctaaattaggtcaaataggaaataagtcagaatccccaattcgatagaaacttacaggtcttgtgatctaatctgccacttgatccgtgaattacctataggtcatccctaagaggtggcctccagcttctgcttgaattccttcaaggatggggtgctcattgctgagaatgcagtcatcacccaaagaaggggttattgtgatatttacaattgctgcctgaccctgta

SEQ ID NO: 53831 - DNA, 2511 bp, Homo sapiens
caatgaatggggagtaaatacacagataatccaaaattgatgtaagcattggaaggggaaagagggaacgcttctttccctctgggcttggtcatttcctcccaagcaaaccccgcgacgttcagccgtcttcctcctatgccacgtgctctcaccagaactgcagcaaaactgcattttatgtcctgtgtctaaagctaaacacatgttcctgtctacttttgctttgttcctgtttcccttctgtgaggaccttcccctcctcagatgtggggagttgccgcctccacttgcattacatgtatttcagagtaggtcctaggctccccttacacctctggtcacgttgccattattcctatggtagataaaggggatgagaaagaacagagctccaggcctttttcaaacaaactggttttctcagtatagccctatgctcaaaaggagtgaggacaggtatgtgactgccataaggagctgtttgctttgcacagagaaatctaatctttctcctgctgggcagctcagtacagatgtcccctcactgctggaagaaacacctgcccttgcttgttctcctgatggcccctcacagtcaggtgtgggatggcacatttctaggtgctcctcgccgagctgtcatgggcttcagtcttgggcctctgcagctggctgtgaccaggtggaaactgtagccttggctgacccagagaaggaaaggaggcagtctgccgcttggctgatttaggagttgtgctgaattcctgcccatctgttctcccagctgagccaaggccaaagctgtctaccttttgccaacctaaggaatgacacagagcatggagcaccatcactgaaacatctgccccagtgccctgccaccttcgtcctcactgacctctgcagcctctctcatctgccaattttgattccgcaaggagaggtggccctgggctcacagctggtgtttgtccacagatgttcatgggtttctttgtgttctctcattttttcaaagctgggtgttgggaccaacatcaccactgacattctgtggctctaaacaagtcctcacgaccacttctcagttttctcatctttatgaagtatggagtaatccccactagccttatagagggactgtgtgagaagggaagagactgctattgtttgccctatatccacctacttccctagttccagaacgctggactttaatgagataacaaagtacctagtaaaaacactgcatcattttccatcccccaccccttgcagtaaaatgtggcccatgagacagaagcactaactactgagcaggacttctaggggagttctttaaaactcagaggagcaccacttttaccttctgctcttccctttttcctgcctggaacgcagaagtgatggctgaagctcctgaggctataagctctgtacgtaggagagtggtgaagaaaggagcttggttctgcaaggatgttgtagagctgccataccagtcctgcatggtattcctgtgcactactgttacgtgaacacacaaacacctaatttgtttaagccattaggccaggcctctattagccattcctgactgatacagaagacaaaaatggcatcacagactcctgaactccaaagacactgcctattctttcgtctgttcttggcaagcaccaacattgagactgtacttcagggttgatgctggccatttggtggcgtgaggagtgggcactcacatgtctctgctagcagttctgacgtgtccattccacactggatccatagaacgagggaacacaagtgtcttctcataagatttatagaaacagtgatcgttgcagaaaaataattagcaagagaacagacttcagctctctgaaggctgatgaccacctgtttctcatctcttctagtgtatgtcaaagctaaattaggtcaaataggaaataagtcagaatccccaattcgatagaaacttacaggtcttgtgatctaatctgccacttgatccgtgaattacctataggtcatccctaagaggtggcctccagcttctgcttgaattccttcaaggatggggtgctcattgtggcttttctaatcatctctgattgttagaaacactgtgaaacttttatccatcagtcctgtttctgaagctgtacggtacaaattttttttttccccacttaaggctcaactattggaatacatctaccatgtctcctatgaaacttgcttctccaggccaatcatccttacttccttaaacttttttttttcctgaaaagttattcttttaatcttattaaaaaagcaacccatgcccattccacaaatacaagtgaaatagtgaaaaacaaaaatcaaactacatctatttggtgatcattattaatgtcttatgtttcctcccagattgttttctgcatgaataataaccaacaatgtgtgtgtatgtatatatatgcttttgcattaaaaggtggttttgaaggt

SEQ ID NO: 53832 - DNA, 636 bp, Homo sapiens
tttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggaattgtgacccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaa

SEQ ID NO: 53833 - DNA, 795 bp, Homo sapiens
tttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggaattgtgacccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaaaaaaaaaaaaaaaaaagtttggttagttactgtgaaatgaactgtttggctttaattttaccaggtattttttaactttctttaataaaaacactttgaaggctttggttcaaaaaacacacacacaacaagcacgcagtataatacaacacacagagg

SEQ ID NO: 53834 - DNA, 405 bp, Homo sapiens
taatcaccaattttaagggcttatttagaactgagtgacttgggagttgaagtagacatcaacctaaacaggaagagaaaacaaaagaagaaagagatttcacacccaatgaccatgcaggaacagacatgaaaaagaactaataagaagtctcagaaatggaaaatactgtctttgagaaaaaagttcagtagatgagataaaccataaacaagacacatagagaaatagtgaattgaaggcagtgctgagaaattctccctgactacagctcaaagaaattaagagaaaatatgaaagcgctatactgtagattcggtattctaaccagtctttcccctgaaagaaactaaacatactaaataaaatatttgaattgtctttttaaaagcaaggctaagctag

SEQ ID NO: 53835 - DNA, 366 bp, Homo sapiens
aatccctgataatgacaagcagactttacccagcttatttttttactgtttggctctgactcaagctaaaaagttgctattcagcagagcttgagttatttttattgttatagccgggcttggtctaggatgtatttggctaaagttgatcttgaccttggatttccagctggctcaggctggaggaaggggaaaaggccctgggaggatgagtggcagatggtgggcatgcctcgcaggctgagccgctggcccttcttccctgacagatacaatctgtggggagagaagaccagagtaattgagaagaatgtcaattttttttttttttgagacagagtctcactgtgtctcccaggctgcagt

SEQ ID NO: 53836 - DNA, 406 bp, Homo sapiens
tatctattgagtgccacaggtatgcccgtgtattgaaaatgtcagagataagagatgagcagacaccctacactgcagcgctgcccaacagagttaacctgtaaagaagcagggcggccagcactcccagcctctctgtcagacaggactgtcagggtttgatctagaagcaaagcccctctgttttctgcctaatccctgaaagagtcatgcccttggggagttcatggtccagtggggagcaaggccttgagaacacaacaagcacatctccaggcagggagtgaacagcgtgcagggcccagcacacggtggccagtgctgagagtgagggacaggatggggccggagtcatcccactgagacacactatcattgctgtgttttagaatcaaacaatccagaa

SEQ ID NO: 53837 - DNA, 214 bp, Homo sapiens
cgaacgcaagttttatgcagtccattagagtgcatgttaagcctactgtgctttgccacaatgattttttacaatcaagtaaaataacttggcctttacaggcctttaaatgcacaaattatgccctgttgtgattttcatctgatcaactcaaccggatagcatgagaagattttataaatatacacaaataaatatgcacttatttcataac

SEQ ID NO: 53838 - DNA, 363 bp, Homo sapiens
gcactgttgtaggtaattcagaacttaacaaagacatttcctggttattttcaactgtgttttttttaggattataccttatccctttatttcctctaagaaatagttttagataagaaaaattactaaactgttatttgtagtgacccactatgagtttaattctttgctaggtgctatggaggtttaggaaaaatgacaactttgctcccagactgaagtacagtggcgcaatctcagcttactgcaagctctgcctcccaggttcatgccattgtcctgcctcagcctcccgagtagctgggactacaggcgcccaccaccacgcccggttaattttttgtatttttagtagagacgggg

SEQ ID NO: 53839 - DNA, 556 bp, Homo sapiens
cagtcaaaccaacaaccacagtataagcatgagaaaaacatcagacaaatcttaactagagacattctataaaaatacctgactagtactcctcaaaactgtcaaggtcattaaagcaaggaaagtcttagaaactctcacagtcaagaggaggctaaagagacatgattgctaaatataatgtggtatcctggattggatcctagaatagaaaaagacacaaggttaaaaataagtaaatctgaataaattgcgaatttcagttaataataacgtatcagtagtggttcaatagttgtgacaaatacaccatactaatgttaatagaaaaaatgatgtgtggggtgtatgaaaacttcctgtactatgtttgcaatctttctataaatctaaaattgttctaaaaataaaacgtttataaaatgcagggaaaaccagagtttacttattttatcttcatttattccatttccactgttcatttctttgtgtagactcgagtttttgctgggatcacagtcctgctgaagggcttcctttaacatttcttgtagag

SEQ ID NO: 53840 - DNA, 753 bp, Homo sapiens
ccctgagcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccaggtacgaggcctgtgcctgcccgcccaccatggcctcacactgcatcctggggcggccaccagctggtccctggaacaccaggcagcagggagcggggctgagcagggagctgggcacaggggtcctggggaggttcccgggaccctgcctccccacatccctgaccctcagc

SEQ ID NO: 53841 - DNA, 812 bp, Homo sapiens
cgcagtgaatccgtgatcttggtgcatctctttatcagtgtactacgaaggtcgaggtataatacgtgtatgccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggggaggctgaggcagaagaatcgcttgaacccaggaggtgaggttgcagtgagctgagattgcaccactggactacagcctgggtgacagagcgagactctgtctcaaaaaaaaaaaaaaaaaagggagggctgtctgctttttgtaacttgaaaaactggacatctatgttatatgtactcatggataaatatttcacaataaaactttttaaaaggaaaaaaagtg

SEQ ID NO: 53842 - DNA, 3355 bp, Homo sapiens
ccctgagcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggtgcgcgcgtcagaccactcggtgacactgggcgtctcctacccgcaactgccacggtgcaggctggggccccacacagacaacattggccggggaccctgctcctgggggctctgcgtccaggaggacagcctccaggcctggcacaacggggaagcccagcgcctcccaggggtgtcagggcggctcctgggcatggatttggacctggcctcaggctgcctcaccttctacagcctggagccccagacccagcccctgtacaccttccatgccctcttcaaccagcccctcacccccgtcttctggctcctcgagggtaggaccctgaccctgtgccatcagccaggggctgtgttccctctggggccccaggaagaggtgctcagctgaagaaggcatgggatggagccctggcatagctgccaccatgcctatgtgcccaagagctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatgtgttttttttgagacaggatctccatctgtcacccaggctggtgtgcaggggtgcggtcatgggctcatgggattctcctacctcagcctcctgagtagctgggattacaggtgtatgccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaaagggagggctgtctgctttttgtaacttgaaaaactggacatctatgttatatgtactcatggataaatatttcacaataaaactttttaaaaggaaaaaaagtg

SEQ ID NO: 53843 - DNA, 3385 bp, Homo sapiens
ccctgagcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggtgcgcgcgtcagaccactcggtgacactgggcgtctcctacccgcaactgccacggtgcaggctggggccccacacagacaacattggccggggaccctgctcctgggggctctgcgtccaggaggacagcctccaggcctggcacaacggggaagcccagcgcctcccaggggtgtcagggcggctcctgggcatggatttggacctggcctcaggctgcctcaccttctacagcctggagccccagacccagcccctgtacaccttccatgccctcttcaaccagcccctcacccccgtcttctggctcctcgagggtaggaccctgaccctgtgccatcagccaggggctgtgttccctctggggccccaggaagaggtgctcagctgaagaaggcatgggatggagccctggcatagctgccaccatgcctatgtgcccaagagctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatgtgttttttttgagacaggatctccatctgtcacccaggctggtgtgcaggggtgcggtcatgggctcatgggattctcctacctcagcctcctgagtagctgggattacaggtgtatgccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaaagggagggctgtctgctttttgtaacttgaaaaactggacatctatgttatatgtactcatggataaatatttcacaataaaactttttaaaaggaaaaaaagtg

SEQ ID NO: 53844 - DNA, 3323 bp, Homo sapiens
ccctgagcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggtgcgcgcgtcagaccactcggtgacactgggcgtctcctacccgcaactgccacggtgcaggctggggccccacacagacaacattggccggggaccctgctcctgggggctctgcgtccaggaggacagcctccaggcctggcacaacggggaagcccagcgcctcccaggggtgtcagggcggctcctgggcatggatttggacctggcctcaggctgcctcaccttctacagcctggagccccagacccagcccctgtacaccttccatgccctcttcaaccagcccctcacccccgtcttctggctcctcgagggtaggaccctgaccctgtgccatcagccaggggctgtgttccctctggggccccaggaagaggtgctcagctgaagaaggcatgggatggagccctggcatagctgccaccatgcctatgtgcccaagagctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatgtgttttttttgagacaggatctccatctgtcacccaggctggtgtgcaggggtgcggtcatgggctcatgggattctcctacctcagcctcctgagtagctgggattacaggtgtatgccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggggaggctgaggcagaagaatcgcttgaacccaggaggtgaggttgcagtgagctgagattgcaccactggactacagcctgggtgacagagcgagactctgtctcaaaaaaaaaaaaaaaaaagggagggctgtctgctttttgtaacttgaaaaactggacatctatgttatatgtactcatggataaatatttcacaataaaactttttaaaaggaaaaaaagtg

SEQ ID NO: 53845 - DNA, 2460 bp, Homo sapiens
ctgtgagcacgtgtgtgtgtgcatgttcgtatgcacgtgtgagtgaggggggcacttgttttgactgtcctgccgggacatctgagcctggtcccacccgctgcacacctcgtgcacatccaccctgaagcagacgcagccagtgtgcgttgaaggacagagtctggggcacagacccgtaattcttccacttaacactgagttaatggctctcagagccccagttttctcagctgtgaacggggctgatagaggattccgcctgcgaggtcgtggcgaggattaagtgctatggtgacggccggtgctcagcgtgcctggcggaggtttagcagcggataaatggagatctggttgtgctgtcttcccccacctccaggcctggcacaacggggaagcccagcgcctcccaggggtgtcagggcggctcctgggcatggatttggacctggcctcaggctgcctcaccttctacagcctggagccccagacccagcccctgtacaccttccatgccctcttcaaccagcccctcacccccgtcttctggctcctcgagggtaggaccctgaccctgtgccatcagccaggggctgtgttccctctggggccccaggaagaggtgctcagctgaagaaggcatgggatggagccctggcatagctgccaccatgcctatgtgcccaagagctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatgtgttttttttgagacaggatctccatctgtcacccaggctggtgtgcaggggtgcggtcatgggctcatgggattctcctacctcagcctcctgagtagctgggattacaggtgtatgccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaaagggagggctgtctgctttttgtaacttgaaaaactggacatctatgttatatgtactcatggataaatatttcacaataaaactttttaaaaggaaaaaaagtg

SEQ ID NO: 53846 - DNA, 1794 bp, Homo sapiens
taggctaggtacgaggctgggtggctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatgtgttttttttgagacaggatctccatctgtcacccaggctggtgtgcaggggtgcggtcatgggctcatgggattctcctacctcagcctcctgagtagctgggattacaggtgtatgccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaaagggagggctgtctgctttttgtaacttgaaaaactggacatctatgttatatgtactcatggataaatatttcacaataaaactttttaaaaggaaaaaaagtg

SEQ ID NO: 53847 - DNA, 1356 bp, Homo sapiens
ccctgagcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggattatcgcaatctgacctttgatccagtcagcgccaaccgtcacttctatctgtcgcgccaggaccagcaggttgaatcctgttccctgaaaaagacgtattcggatcctaacccccaggacctgtggctgtgaccttatttggaaatagagtattttcagatgtgactgagttaagatgagggcatactggagtagagcgtgccctaatccaacaactggtgtcctgataagaggaaatgggcaccgggcacagtgtcacgcctgtaatcctagcactttgggaggctgaggcaggcagattactcgagcccagcagtttgagtgggcaacagagcaagactccctaaaaaaaaaaaaaaaaagg

SEQ ID NO: 53848 - DNA, 329 bp, Homo sapiens
cggccgctggagctcttctgccggaccgagggccgctgtgtgtgcagcgtgtgcaccgtgcgcgagtgtcgcctccacgagcgggcgctgctggatgccgagcgcctcaagcgcgaggtgacgcatccgccgggagcgggaggggtccggacccgccgcagcctggccaccgccgggtgactcctgcgggccgcgccctgctctctcgggcacccggcgggggcggggagcctcatctgtaaggggcttctcccaacctgggagctgattataaaagtcgtgggtctgccaggcgcagtggctcacgactgtaatcccagcactttggg

SEQ ID NO: 53849 - DNA, 1461 bp, Homo sapiens
ccctgagcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggttgaatcctgttccctgaaaaagacgtattcggatcctaacccccaggacctgtggctgtgaccttatttggaaatagagtattttcagatgtgactgagttaagatgagggcatactggagtagagcgtgccctaatccaacaactggtgtcctgataagaggaaatgggcaccgggcacagtgtcacgcctgtaatcctagcactttgggaggctgaggcaggcagattactcgagcccagcagtttgagtgggcaacagagcaagactccctaaaaaaaaaaaaaaaaagg

SEQ ID NO: 53850 - DNA, 3451 bp, Homo sapiens
ccctgagcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggtgcgcgcgtcagaccactcggtgacactgggcgtctcctacccgcaactgccacggtgcaggctggggccccacacagacaacattggccggggaccctgctcctgggggctctgcgtccaggaggacagcctccaggcctggcacaacggggaagcccagcgcctcccaggggtgtcagggcggctcctgggcatggatttggacctggcctcaggctgcctcaccttctacagcctggagccccagacccagcccctgtacaccttccatgccctcttcaaccagcccctcacccccgtcttctggctcctcgagggtaggaccctgaccctgtgccatcagccaggggctgtgttccctctggggccccaggaagaggtgctcagctgaagaaggcatgggatggagccctggcatagctgccaccatgcctatgtgcccaagagctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatgtgttttttttgagacaggatctccatctgtcacccaggctggtgtgcaggggtgcggtcatgggctcatgggattctcctacctcagcctcctgagtagctgggattacaggtgtatgccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaaagggagggctgtctgctttttgtaacttgaaaaactggacatctatgttatatgtactcatggataaatatttcacaataaaactttttaaaaggaaaaaaagtg

SEQ ID NO: 53851 - DNA, 2778 bp, Homo sapiens
ccctgagcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggtgcgcgcgtcagaccactcggtgacactgggcgtctcctacccgcaactgccacggtgcaggctggggccccacacagacaacattggccggggaccctgctcctgggggctctgcgtccaggaggacagcctccaggcctggcacaacggggaagcccagcgcctcccaggggtgtcagggcggctcctgggcatggatttggacctggcctcaggctgcctcaccttctacagcctggagccccagacccagcccctgtacaccttccatgccctcttcaaccagcccctcacccccgtcttctggctcctcgagggtaggaccctgaccctgtgccatcagccaggggctgtgttccctctggggccccaggaagaggtgctcagctgaagaaggcatgggatggagccctggcatagctgccaccatgcctatgtgcccaagagctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatgtgttttttttgagacaggatctccatctgtcacccaggctggtgtgcaggggtgcggtcatgggctcatgggattctcctacctcgggaggctgaggcagaagaatcgcttgaacccaggaggtgaggttgcagtgagctgagattgcaccactggactacagcctgggtgacagagcgagactctgtctcaaaaaaaaaaaaaaaaaagggagggctgtctgctttttgtaacttgaaaaactggacatctatgttatatgtactcatggataaatatttcacaataaaactttttaaaaggaaaaaaagtg

SEQ ID NO: 53852 - DNA, 2730 bp, Homo sapiens
ccctgagcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggtgcgcgcgtcagaccactcggtgacactgggcgtctcctacccgcaactgccacggtgcaggctggggccccacacagacaacattggccggggaccctgctcctgggggctctgcgtccaggaggacagcctccaggcctggcacaacggggaagcccagcgcctcccaggggtgtcagggcggctcctgggcatggatttggacctggcctcaggctgcctcaccttctacagcctggagccccagacccagcccctgtacaccttccatgccctcttcaaccagcccctcacccccgtcttctggctcctcgagggtaggaccctgaccctgtgccatcagccaggggctgtgttccctctggggccccaggaagaggtgctcagctgaagaaggcatgggatggagccctggcatagctgccaccatgcctatgtgcccaagagctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaaagggagggctgtctgctttttgtaacttgaaaaactggacatctatgttatatgtactcatggataaatatttcacaataaaactttttaaaaggaaaaaaagtg

SEQ ID NO: 53853 - DNA, 273 bp, Homo sapiens
ctcctgcctcaggctcccaagtagctgagattacaggcacccaccaccacacccagctaatttttgcatttttagtagagacggggcttccccaggctggtctgttggccaggctggtctcaggctcctgacaatttcttatgattggaaaaagcagacatagacgacgtatttactgcaagagacaacagggatgtagattctttatttcaccagttgagacagaaagagagagcatctcaactgggaaggcaaattctgagacaaagaagt

SEQ ID NO: 53854 - DNA, 374 bp, Homo sapiens
ctacagcctgggcaacagagcaagactccatctcaaaaacaaaaacaaaaacaaaatacaatcaaataaattaattaaaatagtgctgctattttttcaagaggctaaggtcctgactgggcatcgtggctcatgcctgtaatcccagcaccttgggaggctgaggcaggtgaatcacctgaggtcaggagttcgagaccagcctgaccaacatagtgaaaccccgtctctagtaaatagaaaataaagtagctgggtgtggtggcgcgagcctgtaatcctagttacttgggaggctgaggcaggagaatcacttgaacctgggaggtggaggttgcagtgagccaagattacaccactgtagtccagtccag

SEQ ID NO: 53855 - DNA, 482 bp, Homo sapiens
ttgggagacagggtctcactctgtcacccaagctggagtgcagggacctaatcacagctcactgtagccttgacctccctgggctcagcctgggcgacagaatgagacttcctctccaaaaacaaacaaacaaacaaacaaacaaacaaacaaaagccctcaccaagaaaatgaacccaataatgatgagccagaccttaaacagacacctcacatctggcagtttcttacaaaactaaacatattcttttcataagatccagcaactgtacttcttagaatttactcaaatgagttgaaacatatgtccacacacgtttatagcaactttacacacaactgactgacaaaacttggaagcaaccaagacgtccttcggtaggtgaatagacagataaactgtgctaaaagaaatgagctctaagtcttgaaaagacatggaagaactttaaatgcatattattaagtgaaagaagccaatt

SEQ ID NO: 53856 - DNA, 399 bp, Homo sapiens
tatttccaccttgttggtcccccacttcctctccaaaaacaaacaaacaaacaaacaaacaaacaaacaaaagccctcaccaagaaaatgaacccaataatgatgagccagaccttaaacagacacctcacatctggcagtttcttacaaaactaaacatattcttttcataagatccagcaactgtacttcttagaatttactcaaatgagttgaaacatatgtccacacacgtttatagcaactttacacacaactgactgacaaaacttggaagcaaccaagacgtccttcggtaggtgaatagacagataaactgtgctaaaagaaatgagctctaagtcttgaaaagacatggaagaactttaaatgcatattattaagtgaaagaagccaatt

SEQ ID NO: 53857 - DNA, 326 bp, Homo sapiens
cggaccaattcctacccaagtggcctccagctgtccgttagctccgcgtctcctgttccccatctgcaagacagggatagcaatagtgcttgtctcctagagtcgttgggaggtttaactgagctaacatttgcaaagggcctggggcagagcctggcacatggcaagtgccacatgagcgtctgtgttataaaagctcgcccagggctgggtgcagtggctcacgcctgtaatcccagcaatttgggaggtcaagtcgggtggatcacctgaggtcaagagttcgagaccagccaggccaacatggtgaaaactcctctctacta

SEQ ID NO: 53858 - DNA, 2540 bp, Homo sapiens
  misc_feature (45)..(45): n is a, c, g, or t
caatttttaagaaatgatcatctagggaaaatgttttaaaatctnttaaaatatctttttgttatactttaaaactgccttcagctgcctattggtaaataaggtctggatatcagtacatgacaacatatactaatgaattgaactgtgaattaggaatgaaaattgcctagaaatttttttatgagttattaggattaaagtaagaatttcctttgctgggctgtgtaggcactaagattccgtggttgttggaggggttaaatttggatctactagtgcatatattttaccgaggattcataaaaacacgacagggagcctgggtcaatccattaccatgtacaagcagtgaccaatagaaaaggaagaagaagatccaagaaggctgaggtaagcagtcttctgaagccctgtcaaagtggaaacaatagatcaaaggtgttcatggtgactgggacgagtaggtttcactgtttcttataggagacttgacagcttaaagtaaaaacaaattattttcgtcaaagtttttttttttctcttaactgatttttagcaaacctcagactgagacacaggactcaacggtgtattcctggaaggcaaggtgctataatggcaggcacaatctgtttcatcatgtgggtgttattcataacagacactgtgtggtctagaagtgtaaggcaggtctatgaagtacatgattcagatgattggactattcatgacttcgagtgtcccatggaatgtttctgcccacccagttttcctactgctttatattgtgaaaatagaggtctcaaagaaattcctgctattccttcaagaatttggtatctttatcttcaaaacaacctgatagaaaccattcctgagaagccattcgagaatgccacccagctaagatggataaatctaaataagaacaaaataaccaactacggaattgaaaaaggagccctaagccagctgaagaagttgctcttcttatttctggaagataatgagctagaggaggtaccttctccattgccaagaagtttagaacaattacaattagctagaaataaggtgtccagaattcctcaagggacctttagcaatctggagaacctgacccttcttgacctacagaacaacaaattagtggacaatgcctttcaaagagacacttttaaaggactcaagaatctcatgcagctaaacatggccaagaatgccctgaggaatatgcctccaagattaccagccaatacaatgcagttgtttttagacaacaattccattgaaggaataccagaaaattattttaatgtgattcctaaagtggcctttttgagactaaatcacaacaaactgtcagatgagggtctcccatcaagaggatttgatgtatcatcaattctagatcttcaactgtcgcacaatcaactcacaaaggttccccgaatcagtgctcatctgcagcaccttcaccttgatcataacaaaattaaaagtgtgaatgtctctgtaatatgtcccagcccatccatgctgcctgcagaacgagattccttcagttatggacctcatcttcgctacctccgtctggatggaaatgaaatcaaaccaccaattccaatggctttaatgacctgcttcagacttctgcaggctgtcattatttaaacacattctcaccaaatctaaaattagtttaatgagctgtttctgacatgaatgtggttaccattaataggtttaggacacaagtcatattcccattgctctcggccaccattttcatttgtgcagtgtatttttctattcaaagatgcttttgccagtcacatgcatcacagcctgcattaatttgcttctctcttaattaataacacagacacagagttaagatagtttatcaactcaaagatagttttattttggtctcttccatagcttattaacactaaagaaaacaattacatccttatacaataaaagggacacatttgtgtatgtttaaaattacttatgcagataccgtaatttacagtataaatgtaataatcaaacaggaggataacgacctgaagaaaatgagaaaataaaatatttcttaattgtaatcataataaaacaattgcagattgctaagtagctgttggtggtacaagtttgatatttagcttgagaatgggtatggaatgaatcaaatacttcatcactaaagaattcttgttatttaatatcaaataatgaaacagcagtcacttctagttcattaccatttcttgtagctgttgtttttagatatagtccactgcattcttataagttctaaattttatgtttattataatgcatttcttgtggaatcttagtgttttaacatttgaaatccacttaaactgcaaattgttctttatatttgattgtgttttttggattttctaaataaaaatattgaatgctttctaacaaaacagaatatttcaaagaaattagcaagcttcattaaagaacatgttttaataaaaatgtgttatagt

SEQ ID NO: 53859 - DNA, 1752 bp, Homo sapiens
aataaaataaaaatcaacacataagcaagttgccaatttatattatgagctaacatctagtcagaaaaatattctccatttactacttatttgtgtaattgaaatatgtagaataaaaatgagcattgtttttgagaagatatttagaagccattttcttacaaagcaattaaactaaaaactgtgaaaaaccagggcaatgttcctcaaaatttgcagttgatgtgtttgaaatctgaaatttcacaatttttatttttcaaggctatactatttaaattattgatggcaaaacagaatcaattttaagcaaatatagtaatttagaaagtaaattgaaaaaaagaaggtgaaagttattttctcaatcatgcaactgagagacacgcaatattggcagaatctgacctgttacacagaatgaaataatatcttgctgacataatcacaagggcttattgttttcgcataactatgtttacaataatgttgatgccaaactatgctgtttaaaaaacaacaacaaaaaaaaaacaacaaaaggattttgaactgctgtaaagcgagtatacagcagatggcggtgttacttctcttacagttctgctttgatatttactctgtaccattcttcctcctagtggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttgttggcttgcatttgcatgttttataccaaagcttatactgtactatgtgaagccatcagaagtcgcaagggaattgttaataacataaaacatttttatactaagatcatttgttttgtaattcgtttttaaagagtggcttggatgttttgaaaatactactgaatatgttaatattcttttaaatcttagattgaaaaatgatacattacttaaattgatagctcctaatatatttttaaaattacaactaaaagaagacttcttctgcagggaaaattggtcagcaaagtgaaattaaaaattttaaagtttttcccactctcgttggacagtaaatcagtgaaaggactgccccagttgagagtttgctctctttaagtatagaatgtttcctcttaaacaaattgccaatcatccagcctttactacttagccctctgacaaagtgccttactggctatttaatattacccagcttttatgggcaagtttacaaacattgttttttaaaaaattaaaacctgcaatgtttcgtgattaaaacaagtcttattgcatttgtttcactcttagctcactgattggaaaacatttgtcattttgctctgtttgatatcctcactattatggaatacattgtgcagctaaacaatttcccttgcgcctagtggacattcatgaatgtgtactacacgcaagaagaaacaaaccccgaaagaacacttgttggatttctttgtttttttttttactaaaagagaagttttaaaatgaaatgttttctatagtagatctttgaaaatacaataggtataatactgcatttctcagtgttttacaaagatcagaaagagaaacttctaggaattgcaaagggaaactttact

SEQ ID NO: 53860 - DNA, 477 bp, Homo sapiens
gatactcagagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgaagatctggaaagaaatgatggatctacagaaaaaccctacttcgtaacccctaacctgcatggaattctgatcaagaagcaactagttccccagaagcagaaagagtagaaaagctccaaacagtgtcactcatttttaagtagaagttgtgtaaattaggttgattgtaatttggaaatgttgcttttgagtaatgtgaaatttctgtgcttaattct

SEQ ID NO: 53861 - DNA, 883 bp, Homo sapiens
gatactcagagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgagtattcagtatgtgtgttttcccccttcggtggataactgaaaggtgagatggtgaaggcccatgtccttagctggcttggggatctgctgttacctggctgcaaccacaaaacgtgtttatctggaaagagatattgcttagtagatgttatttaaaccataatacctgagaaataagtcagatgcagaaagacaaatacttcatgatctcacttacatgtggaatctaaaaatgtcaaactcatagaaacagagtagaggggtgatgaccagagattgaggggtcagtaaaatagagagatgttggtcaaagggtacaaactttcagttatgcaggatgaataaattatggcactcacatgtacagcatggtgactatagttaataatactgtattgttaacttgaaatttgctaagctcgttagtattctcaccacacacacacaaagataactatgggaggttatggacatgttcattagcttgactgtggcaatcattttactatatatgcatatatcaaaacattacacaccttaaatatttacagttgttatttattaattatatctcaataaagttggataaaaaaattatacctcaacaaggcttagagaaaaata

SEQ ID NO: 53862 - DNA, 608 bp, Homo sapiens
gatactcagagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgagtattcagtatgtgtgttttcccccttcggtggataactgaaaggtgagatggtgaaggcccatgtccttagctggcttggggatctgctgttacctggctgcaaccacaaaacgtgtttatctggaaagagatattgcttagtagatgttatttaaaccataatacctgagaaataagtcagatgcagaaagacaaatacttcatgatctcacttacatgtggaatctaaaaatgtcaaactcatagttatctttgtgtgtgtgtggtgagaatactaacgagcttagcaaatttcaagttaacaatacagtattattaactatggtcaccatgctgtacatgtgagtc

SEQ ID NO: 53863 - DNA, 1365 bp, Homo sapiens
gatactcagagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttcttggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttgttggcttgcatttgcatgttttataccaaagcttatactgtactatgtgaagccatcagaagtcgcaagggaattgttaataacataaaacatttttatactaagatcatttgttttgtaattcgtttttaaagagtggcttggatgttttgaaaatactactgaatatgttaatattcttttaaatcttagattgaaaaatgatacattacttaaattgatagctcctaatatatttttaaaattacaactaaaagaagacttcttctgcagggaaaattggtcagcaaagtgaaattaaaaattttaaagtttttcccactctcgttggacagtaaatcagtgaaaggactgccccagttgagagtttgctctctttaagtatagaatgtttcctcttaaacaaattgccaatcatccagcctttactacttagccctctgacaaagtgccttactggctatttaatattacccagcttttatgggcaagtttacaaacattgttttttaaaaaattaaaacctgcaatgtttcgtgattaaaacaagtcttattgcatttgtttcactcttagctcactgattggaaaacatttgtcattttgctctgtttgatatcctcactattatggaatacattgtgcagctaaacaatttcccttgcgcctagtggacattcatgaatgtgtactacacgcaagaagaaacaaaccccgaaagaacacttgttggatttctttgtttttttttttactaaaagagaagttttaaaatgaaatgttttctatagtagatctttgaaaatacaataggtataatactgcatttctcagtgttttacaaagatcagaaagagaaacttctaggaattgcaaagggaaactttact

SEQ ID NO: 53864 - DNA, 1046 bp, Homo sapiens
aaagaggttggtcaagatgactttgattataactaccaaattaaccaacatccgagtacttactaagaactaggcacgtaatagatagctaagtgctttatatacagtgtctcatttatttcctacatcatcttttttaatctttagaataagcctggcagctaagaactctggttctccccattttacagatgaagaaactgaggtttattggtaggaagcctcagtttctctaaggtcacacagctggtaagtgatagagccacattcagatcctggactctgattatggacccgctccctctacactctgcaatgctgcctgtagtattcccgcctgctttgacatcctaaatgtggggaaatgtgtttgtgtcatgttttcttagcagataagcaatcaaggaaggatgaaattcaaaaggacaaggtctggatctttttctgtacttagcactgtgcttggcatttgggatcagcagtgcaaacaggtagtagccaaaggaggatgaaacactgggttagaaagaaaaagtcctgctagaacattaaaaaaaaaaaatgatttcacggagaaccctcaacgctttatacttcctttttttttaaaaaaggaagtaataatatgtagtgagtatactttactggcagtcaactatatatattcaaagagcataaaatatgaagccagtgagtgagtgatccttttattaattaaaaaagaagttgagtggggcgcgggggctcatgcctgtaatcccagcacttggggaggccgagtggggcagatcacaaggtcaggagttcaagatcagccgggccaacatagtgaaaccctatctctactaaaaatagaaaaattagccaggcgtgggggcacatgcctgtaatcatagttactcaggaggctgaggcaggagaatggcttgaacgcaggaggcggaggttgcagtgagctgagatcgcaccactgcactccagcctgggggacagagcaagactctgtctcaaaaaaaaaaaaggaagatgaattagtagagcatgaa

SEQ ID NO: 53865 - DNA, 824 bp, Homo sapiens
aaagaggttggtcaagatgactttgattataactaccaaattaaccaacatccgagtacttactaagaactaggcacgtaatagatagctaagtgctttatatacagtgtctcatttatttcctacatcatcttttttaatctttagaataagcctggcagctaagaactctggttctccccattttacagatgaagaaactgaggtttattggtaggaagcctcagtttctctaaggtcacacagctggtaagtgatagagccacattcagatcctggactctgattatggacccgctccctctacactctgcaatgctgcctgtagtattcccgcctgctttgacatcctaaatgtggggaaatgtgtttgtgtcatgttttcttagcagataagcaatcaaggaaggatgaaattcaaaaggacaaggtctggatctttttctgtacttagcactgtgcttggcatttgggatcagcagtgcaaacaggtagtagccaaaggaggatgaaacactgggttagaaagaaaaagtcctgctagaacattaaaaaaaaaaaatgatttcacggagaaccctcaacgctttatacttcctttttttttaaaaaaggaagtaataatatgtagtgagtatactttactggcagtcaactatatatattcaaagagcataaaatatgaagccagtgagtgagtgatccttttattaattatgccctggtttacacgtcgtgatgggaaaacctggcgtaccaactaaatgcttgcagaaatccccttcgcagttgcgtaataccgcccgccatggccttccgtgcgc

SEQ ID NO: 53866 - DNA, 310 bp, Homo sapiens
ttgaagaaaggacagtctctttgacaaatggtgccaggaaaactcgatatccacattcagaagattgaaagtagacccctgtctctcatcatatacaaaaataaactctaagttcattaaagacttaaatgtaagaccccaaactatgaaagcatatttggcaacacagaaagaaaaactctcaaagaaagctatcagaaaatgtaaaacaattaaaaaatacaaatttgacctgatttttaaaaaatgaaaatatttcatcatattgtactgttaagaatcttacacaatcttttccagataatggaag

SEQ ID NO: 53867 - DNA, 277 bp, Homo sapiens
attttgcactgtgtggcctgcctcttgcattcaacacactgttacacaagcactcccaaagggtgagtttctgggtcactcatgacaatctagttagtgccaccatgtgtggccatttttgtgtaactgtagatatttttgttccctaaattgataatagaaatagtaacgtactgcttatttatattgtattgtaaactacaatcaactgaaagctccttttttattttctcttattaagtcagcaatcattttctgaggacctattatgtcatgg

SEQ ID NO: 53868 - DNA, 434 bp, Homo sapiens
  misc_feature (19)..(19): n is a, c, g, or t
aggacacttcagtgtatgntcatggtttatttgtttgtttgtttgttattgagatagagccttgctctgtctcccaagctggagtgagacttcatctcaaaaaataaataaaaaataataataataaaataaactttttgactctctgttgttctgtctacagtttttctgggttggctcaccagccacactttattggttcccatattgtcttctttcttttgttgcttttccttttgctggagaaactcctcaggtgaattttttatataggtctcacggatagtcaaatttctgagttcttgcctgctttgaaatttcttcattttgcccttgtacttgacttgttaataaaaaaataaataaaaacctgccaaaaagaagagatttaaaaccatttcacatggtgaaacctcgtctctactaaaaataca

SEQ ID NO: 53869 - DNA, 259 bp, Homo sapiens
cggcagtttcccccatgctgttcttgtgatggtgagtgagttctcgtgagagctgatggtttaaaagtggttggcagttcccccctcactctcatctcccgccaccatgtaagacgcacctcacttccccttcgccttccgccacgattgtaagttccccagacatgaggaacggtgagtcagtgaaagctctttcctttataagttacccagtctcaggtagttctttataccccacagtcataaagtagtgccatca

SEQ ID NO: 53870 - DNA, 638 bp, Homo sapiens
ttcttggtcagaatgcacggtctggaatcaagcagaggtagatggagtggtcccactcatgggtgatttgtttcctgcttctcttgagttcccaagggaggagtgctcccgctaggggacacaacaatggctccattgagacaggaattgagactatccagtcatttcagcactgaaccaacgggctggaggttactgttttggctggtgcaagtgatcctggcaacaagggggcatttatgtcgttcctacacagtggatggtgagaaaggcatctggaacccaaggattctctagggcatttttagcacttcccatgtatgccactaacttctaagggacagctataacagtctcaaagaggggaatgattgaggtcctttagggaatgatgttttggtacaccccaccccgtataaatcctgagaagctgagctactggctgagggaagaggaaccatgggatgtgtaaggaaagaaggaaatttattatttcagccttatgactagccagttacagaaacaagttactgcaactgttacatggagggttggcactccatatcagtgagttccagatatcgacttgactaaccacagaaagtactcaaaaaataaaaatacaataaaaaataata

SEQ ID NO: 53871 - DNA, 211 bp, Homo sapiens
agaaatagggctgtttgtgtggccctgtcttggttaattctgtgcgtataggcctaaagtaatttatcagcaaggacttttccagatgcatgtaagtaacaaaaaatccaactcaagatggcttaagcagaaaagggcaggagtcctggatccaggtgctgttttgctgcattgctctctggctctccttctcttggctctgctgtcctct

SEQ ID NO: 53872 - DNA, 747 bp, Homo sapiens
cagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagactttagaagtctaattcacaggcaaaccaatacagaattgactgcagttgaacagactagaagtatttgtgggaggagtgacatgaagcatgagttatctgatttttttgtagctgctatatattttaagccttcatttgcaattcatgtaacagttgtgtcataaattacacaataaagcagtcctgttcaaatttttttttaacgtggcttgtagaatttttaaaaaatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtcttttttttttttttttggagatggagtcgctctgtt

SEQ ID NO: 53873 - DNA, 507 bp, Homo sapiens
ttccgctttgggggccttggctaaccatggcatctgaccaaaccataaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtcttttttttttttttttggagatggagtcgctctgtt

SEQ ID NO: 53874 - DNA, 412 bp, Homo sapiens
cagcggcacgatctcggctcactacaacctccaactcccgggttcaagcaattctcatgcctcagcctccggagtagctgggactacaggcacgtgccaccatgcccggctaatttttgtatttttagtggagatggggtttcgcgatctcagctcactgcaacctccacctcctaggttcaaacaattctcctgcctcagcctcccaagtagcccaccaccatgcccagctaatttttatattatcagtagagatggggttttgccatgttggccaggctggtatcgaactcctgacctcaggtgatctgcccacctcagcctcccaaagtgctgggattacaggcgtgagccgccctgcacggccctctttcagttagatttaatcttgtcctcacattcccaagacact

SEQ ID NO: 53875 - DNA, 443 bp, Homo sapiens
agcatttaggctatttcaggaatctaaataacatctcagtcaaactaacattccgagagagaaatgttttaatatatcttttcccagagtagcctttaggtctcggagtgggtgcaaacaggctgggtgatggtcgatatatttgaagattcatgggaatccagaagttttggcagaggtacatatgaatctcaaggaaaaattaaatataatttgatataatgcaaactgcacagtagaatttgaatgcaggacaaatcacaacagctgtttgtcatctcactgaaacagcagtaacaggattgcttaaacaaattccgttcctttctagaatgttcagagtatttaatatttgcataatgattaatctcctgctccagaggaaattcccaaaggaagagacaactcagaagcactttaaattgcaacaccacggcaccacg

SEQ ID NO: 53876 - DNA, 5884 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgcggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacagccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcagttgaatggtcagcgttgcatgtcgtgaccaactagacattctgtcgccttagcatgtttgctgaacaccttgtggaagcaaaaatctgaaaatgtgaataaaattattttggattttgtaaaaaaaaaaaa

SEQ ID NO: 53877 - DNA, 1732 bp, Homo sapiens
ccacccttccaacctctctccacctgcagcttgcttggtgctgtcaggatctggatttggggggagtctctctgtagtggaaccagtgacagaagctgttctttagaattttcaggatggctgtattctgcggtcagaatgagagagtcaagctgggcagaatctctcgccaagagttcaggtaaggtaatgtttattcactgggaatgctttccacagccagacagctatgctaacagtctcaagttttcttccagtttgtttagatttaaatgatacatttgtaactttttaaaaactaaattttggttggatttttcatgaaaacctcttttttctttatcccctaaaaaatggtttgaaatgtcattgttatttaaaaacccgatgtgttggaacttctttaatctgctgtttcctctttttccccccctttgaaagtttcgcatagtgtaaacattcactatgtcttttaccttccctgctcctcccatctgggaggcgctgatgctattacccagtgctgaaaaatggcactctaaaggtatgggaaggaaggagcccaaggcaaccacctgctgtcctttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttctggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggctttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 53878 - DNA, 580 bp, Homo sapiens
aagacagtacgattacataacatttggcccatcctagcaagcaggattatatgctcattttattgagaatgaccttaagcagattaggtagttctcaagtttgaatgatctttatttggcgtggcatcgcttttcctttcagatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaagtggagttaacgaatttttttgtgcctggggttgaaaggcccttggattttttgggtcttataattcacacactttgctttctgagcacattacgtactaggactagtgtctagtatcgtaggacataatatcatagaatcttgtgttcaaacagggatcttagaggtttgaacccataactcatctcactgatgaggaaattgagagctggaaatgttgatttttcccagttaaaacacagctagttaggaataatccagtttcgaagccccctgtgtatattctcatc

SEQ ID NO: 53879 - DNA, 5265 bp, Homo sapiens
gatacaggcgttgtcagtgaggcgttgttaatggtgtgtgtctctccctgtaggccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagcttccttccactgtatagcctgatgtgttttgctacgtgagtgtacgccctaggcttgtctccctggtcttgatccagtgtctcatctttgcacctctctcacaactcctatcagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgcggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacagccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcagttgaatggtcagcgttgcatgtcgtgaccaactagacattctgtcgccttagcatgtttgctgaacaccttgtggaagcaaaaatctgaaaatgtgaataaaattattttggattttgtaaaaaaaaaaaa

SEQ ID NO: 53880 - DNA, 5830 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgcggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattatttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacagccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcagttgaatggtcagcgttgcatgtcgtgaccaactagacattctgtcgccttagcatgtttgctgaacaccttgtggaagcaaaaatctgaaaatgtgaataaaattattttggattttgtaaaaaaaaaaaa

SEQ ID NO: 53881 - DNA, 2009 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccaaattttcaggatggctgtattctgcggtcagaatgagagagtcaagctgggcagaatctctcgccaagagttcagttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttctggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggctttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 53882 - DNA, 4683 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgcggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcctttctatttacttccgttgcttctaatcgggatactca

SEQ ID NO: 53883 - DNA, 1934 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccattcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttctggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggctttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 53884 - DNA, 1182 bp, Homo sapiens
attctagaggatccctctccctactgatatcctacttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttctggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggctttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 53885 - DNA, 1510 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccaccaacagacctcaggaaagaggggatgaacttgcagactctgcgcttgagatcttcaaacaagcatcagcgttttccagggcttcccagagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatgtccctattgtgacagagccatggtgtgtttgtaataataaaaccaaagaaacat

SEQ ID NO: 53886 - DNA, 923 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgagtcagagtctcactctgtcacccagactgtagtgcggtggcatgaccatggctcactgcagcgtcaaacacctgggctcctgtgatcctcctgcctcagcctcctgagtagctaggactacaatctcgtgccaccatgcctggctaacttttaaattttttatagtgatggggttttggagggttacacagactagtctcaaactcctggcctgaggccatcctcccacctcagcctcccaaagtgttgtgatgacaggcataagccactgtacactgcctactttttactttttaaatgtggctactagaaaaatttaaattacattatgtggcttacatttgcagcttgcattatatttctattggacagtgctgaactagagtgttgatctactgtaggttagccattgattttgtattaggcatttagatccctgtaagctgttgggtttaatgattttttcctttggaagattttcctttatgcagtaaaattatggagacacagagtatgtagtattacatattaccagtttgctctcctgaatccctgctggtagcatattaaaaatcagtttaatgttcaaaacaaaaa

SEQ ID NO: 53887 - DNA, 472 bp, Homo sapiens
caaggtcttttttcctagagaatctactccgttgcagaatcattgcaagctcaggagccctcactgattgagtgctgtcagcttgatatactactctggaaaggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 53888 - DNA, 847 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccaccttcatggtgaaacacctcttggagtatacccagacccggtaaagggatggtctagagt

SEQ ID NO: 53889 - DNA, 305 bp, Homo sapiens
gtgtcaggttacttcagttgcatagcatcattaggcacagtttcttctcttctcctattttcaggctttcacagtggtgacagtcttcaattccatgacttttgctttgaaagtaacaccgttttcagtaaagtccctctcagaagcctcagtggctgttgacagatttaaggtaagtggctccttcccctgcccccgtgtcaggagccctccccacacaactaactgctggctctgttcaaggggccacccaggctggcctcactgggcttaagcttggctttggccttttggcaagttggtaa

SEQ ID NO: 53890 - DNA, 5999 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagcttccttccactgtatagcctgatgtgttttgctacgtgagtgtacgccctaggcttgtctccctggtcttgatccagtgtctcatctttgcacctctctcacaactcctatcagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgcggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacagccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcagttgaatggtcagcgttgcatgtcgtgaccaactagacattctgtcgccttagcatgtttgctgaacaccttgtggaagcaaaaatctgaaaatgtgaataaaattattttggattttgtaaaaaaaaaaaa

SEQ ID NO: 53891 - DNA, 2896 bp, Homo sapiens
cactctgtgctctgctcctcagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacagccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcagttgaatggtcagcgttgcatgtcgtgaccaactagacattctgtcgccttagcatgtttgctgaacaccttgtggaagcaaaaatctgaaaatgtgaataaaattattttggattttgtaaaaaaaaaaaa

SEQ ID NO: 53892 - DNA, 5293 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgcggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacagccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctcctcctctcctccagcattctcctctgagcagccttagatagtgtccatgg

SEQ ID NO: 53893 - DNA, 2181 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccaaattttcaggatggctgtattctgcggtcagaatgagagagtcaagctgggcagaatctctcgccaagagttcagttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttctggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggctttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttcccaaaaaaaaaaaaatccgggtcttttcgggggcgaacggtatgatggcacggctactgtccgccagtttggccaggaatccgggccatggggtaatcggaacggtgtctcccgcccaaatcgcaccggcgctcccaggggaattccccaccccgggatagaaacaaacccaagt

SEQ ID NO: 53894 - DNA, 2669 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagtaagttctaaccatcctttccgacagtctccaggggcccggccacggccagctctaacactcttattctgttgcagaggttgtgctcagctttgggctaggtagcagtcttagagatgccttcaggtctgttgaaaggggtcgatggattttggcaacagctggaaggatgaaagggcagtgttgccagagaagaaatggaactggcttgatttctgggtgggggtgaaatggaactgactccagttctgcacaggactgtgcttctcggttgtgtgttaacatgaactgacagtcggtgcaggcagatgtgtcttgcagtgctatgagtgggtgagagcacgttgtgtggcccgggctggtgagccagcaccgggaacataccaagtgcctggaggcagttatcacatgtttggcaggtctgtggcaaataagccctgagaaaactagaggactgtcgaggattttagagtctgacctggagtccgtttaagtttggcttatagtgtgactgtgtggcaagtgttggggtggcagccgtggttttccccagtctgtactgatgcagagtagacaagagagcctttgacgttcactctgtttcctgggcacctgtttcttacacctgctgtgctgccttacacttgagaccttgattaaatctattctctacacatttgccttgaggcatcggagcagtagtactgcttgtactgtgcgttttccatatgtgggtaagctggaggttcatggttttggtaagtatgtgcctaagatgcatggcaattaggtaaaactaatttgcagttttgtttttgtttttatttttttaacgtttgatgcctcttgttaaagttttgatctcttttctgaagcagagaacactacttttctggtattgggtttctatattattaataattgaccaactaacatactttatataaaagttttaagtaagaaggaccatgtaactgaaatgttgtgttatgtaatttaccaaaatggcaaacattttcatagagccagcttcccccaagaagagcttctgtcattgtttcactacagggctggtggctgctctgatctcatagaattcattcctctgggtagcaccatatgcaggctttgcgaataaagtgatcatgggctttcttgattccatttggccaatgcaagaacttcattggctcccctctaaaaaaaattccatggattgctgggatttttattttttattttttgaaaaaaatggtacctatccgtattcagcttggtggcttcacagtccctcccctgaacatccgtatattccttattctctcatttatggtgcagaacactggggtactaacctctaggaaactgttctagctgccagggaaagctaagagccctcctttaacaggaaagcagcagcatgctttttcttctctctgccgtttcagggaagagcaccttaaggccagtgttatttcatgggattctgccctagagctgagaaagtaatggactcatccataatctcttttatagatttgaaagtgtaaacaatacacacttccttttttggaactccaattctaatatgtttctttttcattggaaattgaaaaaccaggctggttttgagattagtactagcagtgagtaaacctcctgtctgtggacttaaatccttttgaggaacatttcgttttagatttttacaagttttctaatctggcacgactttcaaactagcttaatctgttcttacagaaacctgtgtaaggacagactgcccacatacgggctccccaaataaaatggcatttttatttcatgtccctgctcgggtttcaccgaaccttggtagccataatcagaacaaatgaaacac

SEQ ID NO: 53895 - DNA, 2402 bp, Homo sapiens
gggagatgaggtgggaggattgcttgagcccaggagttcaagaccagcccggggcaacatagtgaaaccctgtctgtacaaaaataaatctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgcggcagtgtgggaagtggaaaaacctctctcatttcagccattttaggccagatgacacttcgtgggcagccacttcgtgggcagcgctgcccacgaaggtgacccggaaagaagcagaagtcgagtgaggtgaggaccacacagaaacattgagacccagactttcccatcatttagcatattgccagggaaagtgcccacacaggagaacctggaatccccaggccatagttagtcctggccatgtaactttagccatgacagtaatctccactttgttcattaccagagtgaacagattagtgcacaggatgaactgtaggctgggaatggtagctcaggcctgtaaaccaggactttgggaggccattcggggagggggtacgagtcgaatcgtaatatgtcctagtgttctggtgatgtc

SEQ ID NO: 53896 - DNA, 336 bp, Homo sapiens
aggccggggtctgaacgtgtgttcttgggccccagtggggaagcattgcttacgtaaagccgtcgagggtcccacaaaaccatccagccttaagaaggctctgagcagtcctgcagaaaggcagcccatttaagccaatttacccagagtttcccgaatttatttacccaagcgaacccctttttccttaaaatgtctgtgaatcaatcatgagattgaaaggtttcacgcccttctctgcttgggtgctattctctacctccatgaactgttcttgctgttcaaatctgagtagaaatcctggacatttggatttgcttgattagaaaacccttg

SEQ ID NO: 53897 - DNA, 522 bp, Homo sapiens
tccttccctctcttaggcaaaccttttagagaagtcagctgagcaaatatgtacaggtgaattcaaagcaaaagcctcacaaagttgatttgccttagagcaaaggacagttcctttcttcaattctaattagaggtgttgggtttttaattaaatatattactgctgtacttagaggagttcttaaacctccaagtaaaatcaaaaacctctttaaaatcaaaatttctgtcttgatttatttatttattattttttttttgagatggagttttgctcttgttgtccaggctggagtgcaatggcacgatctccgctcaccgcaacctccgcctcccaggttcaaatgattctcctgcctcagcctcctgagtagctgggaatacaggcatgcgccaccacacccagataattttgtatttttagtagagatggggtttctccgtgttggtcaggctggtcttgaactcccgacctcaggtgatctgcccacctctgcctcccagagtgccaggattacag

SEQ ID NO: 53898 - DNA, 299 bp, Homo sapiens
ttttttatgtctcagtagtattccgtcgtctatttacattacattgtctttatttactaattggttgttgggcacttaggttggttccatatttctgcaattgcaaattgtgttgctataagcatgcagattttacatacagttttgaagattgtttttattataaacttttagaatggcaattattttctttctccactaaaatatgtcattccattagcttttgtctgcaattatttctattgagaaatttcttatcctcacttctttgaagagaacatatccattttatttgtgct

SEQ ID NO: 53899 - DNA, 506 bp, Homo sapiens
tttgtatttttagtagagttggggtttcaccatgttggccaggctggtctggaactcctgacctcaagtgatccacccgcctcagcttcccaaagtgctggggttacaggcgtgactactgcacctggcctggttttttaaagtgatataaataatagattttcatagtagaaaaaagtgaaggcctgtattagcaaaagaataaaatataaatcacctctgctctcactaccaagtgataatcattgttaatagtatgggatatacttttttctagagtgcttttgattttagaaaaaggggagtttggtctactaaaatctgcctttacaaaaaattgggagcagtgttttgaataacttttcacatcacttgtatgtgtgtcccatcattttttagagctgctctgtgatgtgggttagcagtctactttcccccatattgttctgtttgcttctactttttccccatgataattagtaaatattaaattacatattttttcc

SEQ ID NO: 53900 - DNA, 87 bp, Homo sapiens
  misc_feature (76)..(76): n is a, c, g, or t
ctctcattaactacaacctctgcccatgttactcaaaatgtgattcaattcagttattcattcaacatacgataantgtgtgccttg

SEQ ID NO: 53901 - DNA, 353 bp, Homo sapiens
aggggccagaacacacatttttaactgacacctctaagaatacacaggtgagatgatcaccaggtttactaagaaattcactgatggatctcctttgcaggccagtgttgatggcaggggaagtggtcatttagatggctcattaatatacagatgaataacctgatcctggagtaacagaacctcaacagtcagaagtcagtagtcttcaattcaattaacatgttgacctgcaaaattggagtggcagccagtggaacttgtgaagatggttaataaactatggtatgcctagaggcagccaacaagggtatctattaacattgacagcaataacatgataatattgggag

SEQ ID NO: 53902 - DNA, 470 bp, Homo sapiens
aaaaaactgcaactgtaaccaaggtagctttgcctcttttgtagccttcctaaggctcaaacagaaaccttgtcatattcctctctcacctgatgagcaacagttatagaaattctataactaggagggtagcttaaatcactcaagtccatcttgtgggtgtgaaaatatttcattcccaagatataaagatctacatttaagtctcacactctttttctgccccaacttaattagaaattattcagaatgatttttattagaagtttatatgttttatggcacaataagaaaaataagtaatagatgtcccaaactgctactcagccttctctgcaactaaaacacacatcattagattcttcagcaatgttgtttagtactggctgactttcatccagacattcttgatttgacgctgcatccctgccccctcccgtaatctctcttttgccaaaggtccaagtttt

SEQ ID NO: 53903 - DNA, 427 bp, Homo sapiens
aaccaagaggccgtatcttcatttttgtcaacaactactaagagtcaccccaatgggtgatgtgccagaaatctatttaaaataaactgcctatcgcacctcattacatcaccagtgaaactgtacacaatgtcttcaaaactgcatctgcattaactcctaaaagcaaaagcgttctgcagcaaagacaaggccaagaaactgggagtcaaacccatgaagtttggctccccccaatcaatctcatttttactttaacttatccccatgaacttgacatgccacccagacaaactggcagcttttccatcctattaggttttaattatgaaactggcttcataccatgttattcggagaggagtccctccaccaatgaggctgctcctacagtctctgatctgctgaataaataccaattgccaga

SEQ ID NO: 53904 - DNA, 330 bp, Homo sapiens
agagacctggaataaagccactattaatcaactattagtttggtgactattagtcaaagccaggaccagagccagaagctggactttcctttcccctggccaaaccttgtgtgcacactgtttcttcccctccccaccctgtcaggccattgatgtgatggctccccattcacaccttcatttctcctctttaacgtgaccagggctgttctgaacctccttactttggcctcctctgcccagaacaggtcaggcccctctgcatccatcaaccaggtgtgctctcctgaccattctttgtcagatgggcaccttcactaactcagctct

SEQ ID NO: 53905 - DNA, 339 bp, Homo sapiens
ggaggattgcatgtcgggtaggggagttggggtggacatagacttaaaatcctccccaccaacaaacagctcaggacctgctgttcctgtgtctaggcagcccagcttcccccactgttcccccccttcatctcccaggtgctacaggacccccagagcgctgtggtgagccaagcagatatgccccaggtctcacaaggttcagtctggtgggaagacaggccctaaaggagaactgacaactgggttatgtggtctcggggttcagagggaggaagtcaaaaagggggaaccaacccagggcctgcttcctggaggaagaagtcatagggtagactt

SEQ ID NO: 53906 - DNA, 319 bp, Homo sapiens
tgcctcagcctccagagtaactgggattacaggcgcccgccgccacgcctggctaatttttgtatttttagtagagatgggattttgccatgttggccaggctggtctccaactcttgatctcaggtgatccacctgccacagcctcccaaagtgctgggatcacaggcatgagccactgcgcctgcctccatttcctttttataattcatccctgaactcccttaaggtagagaagctgtttgatcgtcccagcccctgggaggctgaaaggtaacttcaccagctccatgcctgagtttagcacctgctgtgccagg

SEQ ID NO: 53907 - DNA, 1267 bp, Homo sapiens
gaggaaccttattaaaagttatatttcctattagtagccttaagaatggcaaatgaagacctctttttgagactgtctgcttgtaaaaattttttaaatatgtgtctgtactatagagatatgtgtatggctgaatgtgctttgtgtatagattattgtcaaatggtacctagattattctatatgtgtgcaacagtgactttgggccactctctctttgagaaaccaatgatatgatggcccggagtagataggatcataatgatttaagtttctaaaaaccactggtaaatgaaaaactagtaaactgagctgagatttagggatgttgggcttcattcccagatgaactactttggagaatcctttcctttctattaggtgaggttaaacaagttgctttctttttctttctcttactttccttggctagtgtacagactccataaaatctgataaaaggggtttcctgtagtctgacccccgacattgaggagactgtaatggaggtgacttctcatgcaagatttggccagcgttctagcagtgtcccgggagtgccatggtttggcaggaagacaggaaccccacaaggccaacttctgcctggacttcggcctgaggagccagtgggagccagtgaaactgtctgactctccacatgcgtcagggccctgccgccctggcaccaaggctggcacgcaccagagggcaagtggagaagcggatggtggctcccatgttatctgactaaccactgggtgggctacactccctgtgcccccgctgttgcctctgataggagtatgcttggttcttggtattgacttgcctttttttgttgttttttaaaagcacccattttgttcaatgcttctgttctattactcaaaatgtagccaaaatagaagggaatcaattactagtgtattattttgaaagcttcaaacagaaattgtgaaatgttatttctgctcatattcttagtgttttctcttggtagaatcataatgtttagcctttatgatatttaaaacccattttgagtgttaggtttatttttatgatactctgccggtaacttttaagtcatcaggctaggatatgaagagtagttttttaagtttatgttttaaaagtgaaatattgtgaatctttcatcatagttctcatcaatatccctcagaatttttaaatgttaatgctttaatatttaggaaaaattttataccaaagttgaaaaaaaatagaatcctgttactcccga

SEQ ID NO: 53908 - DNA, 414 bp, Homo sapiens
  misc_feature (57)..(57): n is a, c, g, or t
  misc_feature (59)..(59): n is a, c, g, or t
  misc_feature (93)..(93): n is a, c, g, or t
gccaaaatagaagggaatcaattacctttaaaaagggggttggggtacaattttcantntttttgcaacagacgggggccctttttttcccanaacaagaaattgtgaaatgttatttctgctcatattcttagtgttttctcttggtagaatcataatgtttagcctttatgatatttaaaacccattttgagtgttaggtttatttttatgatactctgccggtaacttttaagtcatcaggctaggatatgaagagtagttttttaagtttatgttttaaaagtgaaatattgtgaatctttcatcatagttctcatcaatatccctcagaatttttaaatgttaatgctttaatatttaggaaaaattttataccaaagttgaaaaaaaatagaatcctgttactcccga

SEQ ID NO: 53909 - DNA, 398 bp, Homo sapiens
ttccatcttttttccccccatttttctatcttacgaactttctgatcaaatcttttgcctatatttttattgggtcatttatcttactattaagatagaattctgggccgggcacagtggctcatgcctgtaatctcagcactttgggagtctgaatcaggcagatcacttgaggtttgaggtcaggagttcgagaccagcctggccaacatggtgaaaccccatctgtactagaaatacaaaaaatcagccaggtgtggtggtgcacgcttgtaattccagctactcaggaggctgaggcaggagaaccgcttgaactttggaggcgaaggttgcagtgagccgagatctggccactgaactccagcatgggagacagagggagagtccatctcaaa

SEQ ID NO: 53910 - DNA, 390 bp, Homo sapiens
agccagatcacctcaggctgcatagaggaagaggttttacttcagctcttaaatccatttccaagtaatttttgtacatggtatccaaaatttttgtacataggagtccagtttcacagtccaattttcccagcaccatttattgaagattatcctttcctcagtgtatgttcttgttgactttgccaaaaatcagttggctgtaagtatgtggctttctgggttctctattctgtccattgatcaatgtgtctgtttttaacagcagtaccatgctgttttgattactatagccctgtagtgtaatttgcagtaaggaaatgctccagctttgttctttttgctgctattgctttagctatttggattcttttttggttccatatgaac

SEQ ID NO: 53911 - DNA, 3367 bp, Homo sapiens
agcggaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaaatttttttttttttttttttaagaatatctgtaatggtactgactttgcttgctttgaagtagctctttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcatt

SEQ ID NO: 53912 - DNA, 2604 bp, Homo sapiens
agcggaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgccc

SEQ ID NO: 53913 - DNA, 2736 bp, Homo sapiens
agcggaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaaggctaccttttgctccattttctgctcactcctcctaatggcttggtgaaatagcaaacaagccaccagcaggaatctagtctggatgactgcttctggagcctggatgcagtaccattcttccactgattcactgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgccc

SEQ ID NO: 53914 - DNA, 2498 bp, Homo sapiens
tcagcaggagtcttagtacagcgtcagggcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgccc

SEQ ID NO: 53915 - DNA, 301 bp, Homo sapiens
aattaaatgacttcccagaaaaaaaaaagaattagtaaatgtaaattcatagactagtaaatagtgtcatactctatctgataaaatagaagaatgtgttggcaaagatgctgatggtacatacagaagctagagaaaaacagccaaaagggtaagaatttgatgttacatttctagcaatgtaatggtctgaggtcagaatgaagggattattaagctttctggctactagaaaaatatgtcctctcttatgggcctgacttaaaggccttgctgaagtcagctgggttgtagtatgtcc

SEQ ID NO: 53916 - DNA, 351 bp, Homo sapiens
gttaattatccaagtaaatgatgaaaaacaatgacttctcatttgggtgcctttatcctccaaacactataattattgtaaaaactctcaaagtatattctgagatgtataataagaatttaaataactatattcagattataacaaaagagagagaatacaacagatacggttggaagtatgagaactcaattatcagccaaatcctaagttttagatgaacacagtgaattctgaaaaaacagactgtttagcccaaaatcactccactaagtagcaggcttaaaagctataatttcatactctttatttcatagtagtttcatatatacaatagattattatatatac

SEQ ID NO: 53917 - DNA, 499 bp, Homo sapiens
tgagggttgcagcagatgcctgtgtccacatctggacagcattgctggctaacgccaaccccacctggcttgggaacaggcttgaatgtgtggtctgtcctgggcaaagagtaagttcctagaaaatcccagcagtcactgggaagtctgatgacttcctgagccgagctcttggtgtgatgtgatcccatcggtggtgttacttctggtttttgtcttgttcacaataggatttggagtagtttacaaaggttaacaaagttcagggagtcagggaagggaaaattaagaaaaagcccacaggacagagtggagcatgtggcaaggtcagcggccgcgtggacgtctccgattgtgctggctgtgctgctgtggccgcggtggggcagaaggccagacgtcctcacttcccccaaccccagtccagttgtacatgttgtgcactgcacaagggccctggcagaggaccaagttggagttgaaatccagccatggcatg

SEQ ID NO: 53918 - DNA, 514 bp, Homo sapiens
ttctgaggaggaagtcccagagcagactttggctcaactctaagagagcagctggaatggccccacaggctacagcccgtgtcggtgtgggatgcgagggagaggagccaggatggccccacatgctttccttggctgcctgggcgggtgcagcagccacctgagagggccgtctgaggacacgaggcgcatcagcctcatgagatctgggatgtgcacgggacgtccatgaagccgtcggagatgatttggagtagtttacaaaggttaacaaagttcagggagtcagggaagggaaaattaagaaaaagcccacaggacagagtggagcatgtggcaaggtcagcggccgcgtggacgtctccgattgtgctggctgtgctgctgtggccgcggtggggcagaaggccagacgtcctcacttcccccaaccccagtccagttgtacatgttgtgcactgcacaagggccctggcagaggaccaagttggagttgaaatccagccatggcatg

SEQ ID NO: 53919 - DNA, 321 bp, Homo sapiens
ttctgaggaggaagtcccagagcagactttggctcaactctaagagagcagctggaatggccccacaggctacagcccgtgtcggtgtgggatgcgagggagaggagccaggatggccccacatgctttccttggctgcctgggcgggtgcagcagccacctgagagggccgtctgaggacacgaggcgcatcagcctcatgagatctgggatgtgcacgggacgtccatgaagccgtcggagatgatttggactagtttacagaggttgacgcagggatgtgaatcatcacatgtgtgtacttgtaaatacaaatgtaag

SEQ ID NO: 53920 - DNA, 491 bp, Homo sapiens
cagcttatgctggcttgggaaatgtgcttgtcaaatttttaggaattctaatagccagttattaaatacagaccttaatacacacacacacacacacacgcacacacacacacacacacaagtttttcagagagccaattgttcaacatttaccaacacacatctgttgtttgagggatatttggcagaaagagcctgggaaggtgatttgggtttgagaagcactgtagtttttttttgtttggtttttagagaccaggtttcactgtgttgcccaggctggacttgaactcctggcctcaagcaatcatcttccctaagcctcccaagtacctgggactataggcacctgactaagaactgtttattggttggcatggccagatttacttgttaaaaatttaggctatgtcttagtcattttccttgtaccagcttccagcccagggcataaaatgtggtcaggaataaagtttgctaaatggatggat

SEQ ID NO: 53921 - DNA, 429 bp, Homo sapiens
aaaattccatctttgaaagggccggaaattcccccacctaaacaaccctattccctgggcaaacaccccccttcacagtgattaccagctgtccccattccagaattatttcagttccttcaaagcaaggagagtcctgtttaaagagttgccttacaaattgtatttttattggtgatggtcactcctgtatagcaccccaaggaggagacactaactgcatcccattatggcttatgatgccgtctgtcagatcatttctgcaggttaggtaccagtgtaaagttggaaagagtagtgctgcaattgacaactgaggtaggacctcaggagtcatctgtactctgatgggctcatcagcttactaatgactattcacattctgttagggaaaaattatttatataaaatgttcatattcatcatcaa

SEQ ID NO: 53922 - DNA, 317 bp, Homo sapiens
tccaacatcaccctcccatctaggctgccgggctgcccagcccccagtggaccctgcctcccctaaggccttgcttacccccacccggatatttcaacatcattactggatgggaaggtggaaattcagtcactgttttgttatatagccacgattcctaacttgtgtggggaaaagtttacatctttattgtcacaagcctttaactgaaattgagcattctcattcatcataaatacaaacagcgagccgtggtattaacagtactataactttgtcatcaatagaaatccagataatttcatcttctagttatg

SEQ ID NO: 53923 - DNA, 502 bp, Homo sapiens
gtgtttttttgtttgtttgttttaaagaaaagacttgtaccatcagtcttaggcgtaatctccttggcagtagtgaggagcaaggcatctgatggagaaacaaagcatggtaaggtttttaccattcaggaatcacaccgcagtagcattgtagtatttgatcacaatttactcttactttttttcataaagaaagaaataggcctacagtggctctcacttgtaatcccagcactttgggaggctgaggcaggaggattgcttgaggccagaagtttgagaccaatctggacaacataggaacacctcctctctacagaaaagattaaaaacattagctgggcatggtggtatgcgtctgtagtcccagctgttcaggaagctgaggtgggaggatccttcgagctaggaggtcgaggctgcagtgagccatgtcataccgctgcactccagcctgggtgacagaggggagaccctgtttcaagagagaaaaataaaaaaa

SEQ ID NO: 53924 - DNA, 196 bp, Homo sapiens
ttatgtttcttttattcactaaagtagctggcacaaaacacaccaaaacctagagcggtagttttatgtaaatgctcatgagtttgtatcaataatataattgttgatccacttataattcgtgcaatactgtatgtatgtagagattgaggtgtcaattaaaaaaatgtggccttaaaaaaaaaaatttaaaaaa

SEQ ID NO: 53925 - DNA, 331 bp, Homo sapiens
tcagcaaacatttactgagcactcagccaggagatatagtggcaaaaaaaaaccccaagagataccaccccacccccacaaccagacatcccagctgaaggaagtatggcctgggtagggctgtaacagggagacagtctccccctgccctgggcaccacgcacagggggctttggcagggagccaggggaagcagagttccaatcaccatttcctaccctatcctgaccctacccaccccaccagcagagctgcattatgactttcctgggccctaggcactttcacctttttgggtcctttcctccataaaaataaaaaataatatttt

SEQ ID NO: 53926 - DNA, 834 bp, Homo sapiens
catatttgctaattgtctcttcatatgggaaagttctcacaactccattagggatttggagatgatgtaattgataatatataagcccagtgtcttttgaggctgctggattccttagagtattgccagccaacaaaatccagacagtaatttgaaagtggaatttgaaataccatcagataacgtgtgaccagctggcccaggagaccttcagtgaatagcatggtaattcatggcacctaacatgaaactccaactttacccatctgtcactgttcaacctcagtttggtcagctgagtcatgtacagtacattatcctgcaaacagactaatcgatctaacctcccctctttcagggctctttcatcattactgggtgaaaaactcaccctgccaaaggaatgatcagtatgaacacgttactgtagctagaacatgtcacagactgttcagatgttctccacaatattagacgtttgataccgtgaatacatgcacaggaaaaagaaattgttcacgtataaaaccatctgacttgaaaactactgctaacaaatggacatgtgtacatccattagacaaagtgtccgaaaatccaagcgctatcctctagatttcacaaacctgtttcctgaaaatacatttgtttatgtaagcctgcttactttcatctccaattctttttatcataagtcacattgactctatctgaaaatctttatgttggttatgtgactaaattttgattcattgtatgccttaagcgttcaaatattcatatattttcttgactacatgactattgaataaatgccattgtcaaaaaccttaa

SEQ ID NO: 53927 - DNA, 1398 bp, Homo sapiens
tcgagttttttttcacccagagatgaggagcacagagctgtgaccaagatgctgaggactgttgggtcttgttttccaggtggttggcaacacgacatctggaagctatagctacagcatccagaagagtctggctttcgcatatgtccctgtacaactaagtgaagtgggacagcaagtggaagttgaactattaggcaaaaattacccagcagtcatcatacaagaacctttggtattgaccgaaccaaccagaaaccggcttcagaaaaaaggtggaaaggacaaaacttgaaaaaagaccttcagcagtcaactgaattagagttgctaatgactgtccttgaaattattataactggctcccaggggaatagaggaaaccaggaattcatttcaaaatcatcaaagtctaaatttagaatcttaatgaaacctttctgttaagtgttttctaagcaagacagaataatagataaatgatttacattgttcttttaaatgaagaaatttgaaatgaatgtttttttatttaccccacattacccaatcagtaaaacatttaggtgtttgctaatatacacaatcattactataacctaattaagggacattttataattttagtaacaaatgcattcggttcttgacagctgaaaacaaattaataaattatcttttacataaaaacatgtacaatattgtttatggatttacttctttgagaaatctttccttagatgaataaatgaaagttttaatttttcatgatatatctgtgatgaaaatagtaaaacttaacattgacatatagccaacattttaattcaattctgtgaaatatttatcattttcttaatgacttccctgaaaggagctttataggacattattattgtcctttcaaaggttgttttagaagagaaattgcaagaaagaacagagtcttccaaaggaagaggtacttgtaaactttcagaaatgaagctgacacataaatagattgtgccagtataaacacagtttgaatactgaacacctctctttgggaaagaattaatgcaagttgacatcacatggtgctgttctgaatatcatttcacaaagcatttgacaaagcaggtcaaacaaaagcttaagagctgacaggttttccttagcgctacgtacagcaagaaaaaaatcaatttagaaataattctttgatatactttttgaaattatttgggtgtagttgatggaataaataaattttttttgtaaagggtggtttctcatttataattaatttatacatacatacatttgttacacatttatagaagttttcttaagtattcaaaaaacagaatgtgaagcacgataagattctgtcatttgaataaactttaaaatgat

SEQ ID NO: 53928 - DNA, 1343 bp, Homo sapiens
tcgagttttttttcacccagagatgaggagcacagagctgtgaccaagatgctgaggactgttgggtcttgttttccaggtggttggcaacacgacatctggaagctatagctacagcatccagaagagtctggctttcgcatatgtccctgtacaactaagtgaagtgggacagcaagtggaagttgaactattaggcaaaaattacccagcagtcatcatacaagaacctttggtattgaccgaaccaaccagaaaccggcttcagaaaaaaggtggaaaggacaaaacttgaaaaaagaccttcagcagtcaactgaattagagttgctaatgactgtccttgaaattattataactggctcccaggggaatagaggaaaccaggaattcatttcaaaatcatcaaagtctaaatttagaatcttaatgaaacctttctgttaagtgttttctaagcaagacagaataatagataaatgatttacattgttcttttaaatgaagaaatttgaaatgaatgtttttttatttaccccacattacccaatcaggacattttataattttagtaacaaatgcattcggttcttgacagctgaaaacaaattaataaattatcttttacataaaaacatgtacaatattgtttatggatttacttctttgagaaatctttccttagatgaataaatgaaagttttaatttttcatgatatatctgtgatgaaaatagtaaaacttaacattgacatatagccaacattttaattcaattctgtgaaatatttatcattttcttaatgacttccctgaaaggagctttataggacattattattgtcctttcaaaggttgttttagaagagaaattgcaagaaagaacagagtcttccaaaggaagaggtacttgtaaactttcagaaatgaagctgacacataaatagattgtgccagtataaacacagtttgaatactgaacacctctctttgggaaagaattaatgcaagttgacatcacatggtgctgttctgaatatcatttcacaaagcatttgacaaagcaggtcaaacaaaagcttaagagctgacaggttttccttagcgctacgtacagcaagaaaaaaatcaatttagaaataattctttgatatactttttgaaattatttgggtgtagttgatggaataaataaattttttttgtaaagggtggtttctcatttataattaatttatacatacatacatttgttacacatttatagaagttttcttaagtattcaaaaaacagaatgtgaagcacgataagattctgtcatttgaataaactttaaaatgat

SEQ ID NO: 53929 - DNA, 485 bp, Homo sapiens
taacttacaagataggctgttatatacagtaaatgatatataaaaaggtaatgacaaatcttgttagtttttcacctttgacaattgattaaacattttcaatacctttccattattgtgtcccccagatctaagggtttccatacacaaaccttctgtttgagaactgcagagagaatgataacctgatatgataaatgtctagaaagactgtggtattaaaatgttttaaaaatcaaattaagaaatgccatggtacgttgctctacaaatatcacctagcttatagctgtactccccttacagactctgtgctaggtacggatctagatttataccacatttgcctgagagaacctacttgacatgaaatttagtgttttttcctagtgggtaataattccttttgaataataataacaatggctaacacttactgtagcacatatttatgtaccagttagtatgctaagtccttacatgca

SEQ ID NO: 53930 - DNA, 3704 bp, Homo sapiens
atgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagcaggtttaacaacttactttcatcctggaataaacttgaagaaaatacattatgatagcatcaaactttatgagaaactggaagaagaaactggtcaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtaggggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataagccagcagacttcataggaaagcaagcactgaaacagattaaagccaaggggctgaaacgaagactggtctgcctcaccttggcaacggatgatgttgatccagagggaaatgaaagcatctggtacaatggcaaggtggttggcaacacgacatctggaagctatagctacagcatccagaagagtctggctttcgcatatgtccctgtacaactaagtgaagtgggacagcaagtggaagttgaactattaggcaaaaattacccagcagtcatcatacaagaacctttggtattgaccgaaccaaccagaaaccggcttcagaaaaaaggtggaaaggacaaaacttgaaaaaagaccttcagcagtcaactgaattagagttgctaatgactgtccttgaaattattataactggctcccaggggaatagaggaaaccaggaattcatttcaaaatcatcaaagtctaaatttagaatcttaatgaaacctttctgttaagtgttttctaagcaagacagaataatagataaatgatttacattgttcttttaaatgaagaaatttgaaatgaatgtttttttatttaccccacattacccaatcagtaaaacatttaggtgtttgctaatatacacaatcattactataacctaattaagggacattttataattttagtaacaaatgcattcggttcttgacagctgaaaacaaattaataaattatcttttacataaaaacatgtacaatattgtttatggatttacttctttgagaaatctttccttagatgaataaatgaaagttttaatttttcatgatatatctgtgatgaaaatagtaaaacttaacattgacatatagccaacattttaattcaattctgtgaaatatttatcattttcttaatgacttccctgaaaggagctttataggacattattattgtcctttcaaaggttgttttagaagagaaattgcaagaaagaacagagtcttccaaaggaagaggtacttgtaaactttcagaaatgaagctgacacataaatagattgtgccagtataaacacagtttgaatactgaacacctctctttgggaaagaattaatgcaagttgacatcacatggtgctgttctgaatatcatttcacaaagcatttgacaaagcaggtcaaacaaaagcttaagagctgacaggttttccttagcgctacgtacagcaagaaaaaaatcaatttagaaataattctttgatatactttttgaaattatttgggtgtagttgatggaataaataaattttttttgtaaagggtggtttctcatttataattaatttatacatacatacatttgttacacatttatagaagttttcttaagtattcaaaaaacagaatgtgaagcacgataagattctgtcatttgaataaactttaaaatgat

SEQ ID NO: 53931 - DNA, 3650 bp, Homo sapiens
atgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagcaggtttaacaacttactttcatcctggaataaacttgaagaaaatacattatgatagcatcaaactttatgagaaactggaagaagaaactggtcaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtaggggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataagccagcagacttcataggaaagcaagcactgaaacagattaaagccaaggggctgaaacgaagactggtctgcctcaccttggcaacggatgatgttgatccagagggaaatgaaagcatctggtacaatggcaaggtggttggcaacacgacatctggaagctatagctacagcatccagaagagtctggctttcgcatatgtccctgtacaactaagtgaagtgggacagcaagtggaagttgaactattaggcaaaaattacccagcagtcatcatacaagaacctttggtattgaccgaaccaaccagaaaccggcttcagaaaaaaggtggaaaggacaaaacttgaaaaaagaccttcagcagtcaactgaattagagttgctaatgactgtccttgaaattattataactggctcccaggggaatagaggaaaccaggaattcatttcaaaatcatcaaagtctaaatttagaatcttaatgaaacctttctgttaagtgttttctaagcaagacagaataatagataaatgatttacattgttcttttaaatgaagaaatttgaaatgaatgtttttttatttaccccacattacccaatcagtaaaacatttaggtgtttgctaatatacacaatcattactataacctaattaagggacattttataattttagtaacaaatgcattcggttcttgacagctgaaaacaaattaataaattatcttttacataaaaacatgtacaatattgtttatggatttacttctttgagaaatctttccttagatgaataaatgaaagttttaatttttcatgatatatctgtgatgaaaatagtaaaacttaacattgacatatagccaacattttaattcaattctgtgaaatatttatcattttcttaatgacttccctgaaaggagctttataggacattattattgtcctttcaaaggttgttttagaagagaaattgcaagaaagaacagagtcttccaaaggaagaggtacttgtaaactttcagaaatgaagctgacacataaatagattgtgccagtataaacacagtttgaatactgaacacctctctttgggaaagaattaatgcaagttgacatcacatggtgctgttctgaatatcatttcacaaagcatttgacaaagcaggtcaaacaaaagcttaagagctgacaggttttccttagcgctacgtacagcaagaaaaaaatcaatttagaaataattctttgatatactttttgaaattatttgggtgtagttgatggaataaataaattttttttgtaaagggtggtttctcatttataattaatttatacatacatacatttgttacacatttatagaagttttcttaagtattcaaaaaacagaatgtgaagcacgataagattctgtcatttgaataaactttaaaatgat

SEQ ID NO: 53932 - DNA, 365 bp, Homo sapiens
acttatttatatgctctcactggaattattgtcacaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggtatttatcttaagggcatttttaccatttgttgacttaagtaaaaattagaaaaagttattaagaagttaactaaaaacagaaaacttggtacacacattttaaatgtgacaaaatcatatgattaattttggaatttgggtaacttacaagataggctgtt

SEQ ID NO: 53933 - DNA, 772 bp, Homo sapiens
tggctcactgcaagctccgccttttagtttcaagcaattctgctgcctcagcctcccgagtagctgggattacaggtgcccgccaccacgcccagctaatttttgtatttttaatagagacggggtttcaccatttgtatttttaatagagacggggtttcaccatgttggccaggctggtctcgaactcttgacctcatgatctgcccaccttggcctcccaagatacttttctatatagtcatacataggactatatagcacatagtcctaaaccttccatctaaatcatcccatttctgaatctctgtacaacgctatccatgttaacttgtagggacttaacatgtatgtttattggctggctctcactttactcacatagttcacattgcttcttaaaacctgtcatgagccttatgctctggtgtgctcaaactggtgctgatgtgttctcatcccaaaggactggctggtgcttctcagtttctttccagcattaaattattgcttaacagataaactgtcaacattttgagaatgttaattttttttcagtatttcttttcctctctgcttttaaggcaggtttaacaacttactttcatcctggaataaacttgaagaaaatacattatgatagcatcaaactttatgagaaactggaagaagaaactggtcaggtaaaggcatttaacttgaaactgtctgttaggtcggcttctcagaaacatgtaagatttctgaaggattttgatgcatcattgtgtat

SEQ ID NO: 53934 - DNA, 463 bp, Homo sapiens
ctgtgcctgcaccagaactgaaatactgtacccccacagttcagagtaacagtaaagcccctgacattgacagggggcttcctgtgtagcaagcagcatgctcagtgttttatgcatgttaccttaatccccgcagcaggcctgtcaggcgggtgttgtttcactccttgaataatgagaaagctgctatctggaaaggtcaaggaactggcccaagatctacagctattgagtgacaaagctgcaaattgaacccagatctttttgaccccaaagctaatgtttttaattgctgcactgtagctgccttcatggaaggggtttgtttcaggcattgataggccattgtaaacccatggccagaggtaacaagaaatcagaactatccctgatactcgaactgatacataacatgttcccatttctgctaaacacacacgcatgtgctcacacatgaatggaa

SEQ ID NO: 53935 - DNA, 244 bp, Homo sapiens
agattgccttccccaactctgaaatctcttttccctttattgaatctttgtggattgttcaactcaaccctctaattaaccacacttgcccattaaattgtgttctccctgtcttggaggttttaccattaaatggcttctctatagtggctagaccctcctaaatctttatcccagctctccaaaagatgggggagattctttcctttgggcagatggggaaactgaggtccatggaggggtc

SEQ ID NO: 53936 - DNA, 352 bp, Homo sapiens
ttacttgtgttctttttgtccctcttcttcagcccatccatgttagttctcagtaggtttgaataagccatccggaacttattcacttctttggagctcaccacaatgctaaccttctttttcccatcagtagttcttaacagacacctgtctgaagactcaaagcccgcaacagaacctttcactagaatgggtttggttcaacctcagttctcaaggaacaaatggtaccaggaaaagtccgctgtaagtgaacccattttaactgagaatcaaaacatcatagtaaatagtatggaaaaaaattaggtttggtcaaaacttcaacttgagaaataaaaccagaaattat

SEQ ID NO: 53937 - DNA, 438 bp, Homo sapiens
acacggggtgagcattgaagcaggtgctccatggcattggtctcacgtgatctttgctgtgatcctgaaatgggtagtattggctgtgcagattaggaacctgaggctcacagaagttacacagcttgaggacattgctcaaaattgtcccagtccagatttgactgggatttgtctgatttattacccatttgttgggggtgtgctgtttccaacagttccttcttccattagttttggttccattaatctgaattttctcagtctaatctagcagagttgcagtgctggacattaacatatgtatgcatcaaacccatccttagggctgtaggaggtactgcatgcaggttatgggagctataattttttttaggttgtaaataccgagtgcctcctctgtgtctacacagtgccaggtactatcggagaatacaa

SEQ ID NO: 53938 - DNA, 336 bp, Homo sapiens
tatcttactggcgaccgtggacagctaacttcgattttgagggggagggacagagacagagaaacagagagagatatgatcgcgattcaatctttgcagaagaaataacccgtgcacaaggggccacaccatcccccaccttacacttcgggaagggtcgttaccgtttttgtggtttttctcaaaagatgtgttttcatcagaaacgggcacatttttcctttctcctaatcgccaacttcccctccattttttgtgagtcccacactccggagcttcactccatttcccctgtctatttctcgggtttcccatcgtgggtaggggagattgcct

SEQ ID NO: 53939 - DNA, 765 bp, Homo sapiens
gaaaaaaacatacacacagacatatatgcatacatacaaggagcagccactacccttagggctaagacagtgtgtccaagaatgagtcccccatttccctaccaccaccccagggctgagattcatacctggttagaaagggctcagttgtggctcactgaatggcagagtaattgctgatgtgcttctctggggaagcgtgctgaaaggcttttcatgagaggtgtcactctgctacaaaactactcagatgaggtgctgagggaagctgctggtctctgagctcacttatatgtcagaacctggctttgaggaactgggtgctgtgggagcctgctgaaaaacacacgggaacaggaagtaaaaatctctccattgttctccgctggcagaagttaacatgccagctgtcaaaggaaaagttttaaagtgtccaggcacatttttgctcaacaggcagaagggatgactttgtgactaagaagcggtaaccagcacagggttctatcgttgttcatgctagctggccactatacccttccagaacaaagcccgtcactgaggacaaactgttggaaatataatccagattgagctgcagagagacaagttagtagagacgaaaggaaaggttcagataaaagcggtagggagaagataaccaggacattaaagaacgtaaacccgggaggcagaggttgcagtgagccaagatcgcaccattgcactccggcctgggcaacaagagtatgaaacttggtctca

SEQ ID NO: 53940 - DNA, 228 bp, Homo sapiens
cgacaaaaaaaaaaaaaaatataaaaaaaaaaaaaaaaaaaaaaaatcctaagaagttggtttaaaaaaaaaaatcatctgggaaaactcaaaataaggggctagaactcttgaaaagaagtaataataaaaaatttcagaaaaatactgaagaataaagagaataaataatatttttcaagaattagacagcgaaggaaaattttttaaatgaaggagaaatacata

SEQ ID NO: 53941 - DNA, 668 bp, Homo sapiens
aaggatttcaggttacatacttcaaatttctagaatggaatggaatcattttggaactggaaaaatggcataaacactgacgtcccttaaaacttcaattttataaagaaaattcttctgcaaaccacatcccctttatgtaacaagactaggtattatctacacctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtattatctcgtgccgaattcggtcgactcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagaca

SEQ ID NO: 53942 - DNA, 765 bp, Homo sapiens
gcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggagaatggtgtgaacccgggaggcggagcttgcagtgagccaagattgcgccactgcagtccggcctgggcgaaagagcgagactctgtctcaaaaaacaaaacaaaaaaaa

SEQ ID NO: 53943 - DNA, 2442 bp, Homo sapiens
gcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcatttttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagaca

SEQ ID NO: 53944 - DNA, 2388 bp, Homo sapiens
gcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcatttttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagaca

SEQ ID NO: 53945 - DNA, 2799 bp, Homo sapiens
gcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcatttttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagacacctgtcctgtctggtgcgaggatgttagaggttgataggactgacaaaagagcctgacagtggttcatgctataatttccacactttaggaggccaaggtgggaagactgcttgagctcaggagtttgagaccaacctgggcaatgtagtgagaccttgtctctacttaaaaaaacaaacaagggccgggtgcggtggctcacgcctgtaatcccagcactttgggaggctgaggcgggcagatcacgaggtcaggagatcgagaccaccctggctaacacggtgaaaccccgtctctactaaaaatacaaaaaattagccaggcgtggtggcgggtgcctgtagtcccagctactc

SEQ ID NO: 53946 - DNA, 2389 bp, Homo sapiens
gcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcatttttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttctaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagaca

SEQ ID NO: 53947 - DNA, 1187 bp, Homo sapiens
  misc_feature (1178)..(1178): n is a, c, g, or t
  misc_feature (1182)..(1182): n is a, c, g, or t
caaaatgtggcacatatacaccatggactatcacatagccataaaaagaatgaaatcatgtcctttgcagcaacatggatgcagctggaggccattatccaaagcaaattaacacaggaacagacaagctaataccacatgttctctcttataagtgggagataagcattgggtactcatggcaaaaagatggcaacaatagacactggggaatactagaaaggcagggggcaagggttaaaaaactaactattgggtgctatgttcactacctgagtgacaggatcaatcataccccaaacctcaacatcacacaatgcgcccacataacaaacctgcacatatattccctgaatctaaaataaaagttgaaatgataaaaaacgtgggcggagggggaggaattatttaaaaaaaaaaaaaaaagcaaattgtggtatacccacataatagaatactacttggcaataaaaaggaattaaatatggatactcacaacatgaccaaaagaatccagaccaaaaaatagtacattactgtatgattccacttatataaaaacctataaaatgtaaacaaatctatactgatagaaagtagctcgacagttgcctgagaattagggaggttagggaagggtggaaggaagggattaacaaagaagcagaaaggcactttggggaataatagatacgttaaccatcttaattgtggtgatggtttcatggtgtgtacatatgctggaatgtatcaaactatacagtttaaatacatgcagttttttttgtaggtcaatcatactgcaataaagctacaagaaaaatcctgcctttctttcaactcttaaatttttccaaatattaaataaagcatgaaaaacaaaaacagaagcttatattaaaacctgttaatgaccaggcacagtggctcatacctgtaatcccagcactttgggaggctgaggcaggaagattgcttgagaccaggagttcaaaaccagcctgagcaatatagcgagatcatcttacaagaataagtcgcagcatgtgtgatgctgtactactatcactcagtaacctgaggtgggaggattccttgagcccaggagtttgaggctgcagtgagctatgatcatgccactacactctagcctgggggacagagtgagaccttgtctntaanggatt

SEQ ID NO: 53948 - DNA, 270 bp, Homo sapiens
agcctgtgtttcatgaaggacatttgcaattagcccacggttgcaaaagcctttgtagctactgatgaaggccaccctgttccgtacccctctgacccatccaagccagatatctttttaagacaaagtacaatttttgtcttagataacacaaaatttatttttaaataccatcacttaaattgggagtcatttaaacttgaattttcttaacatagaaccaaagttgaacgtgtctgtaatccacataattaaaagaaacacaggagc

SEQ ID NO: 53949 - DNA, 389 bp, Homo sapiens
acctcaaccaaaaaaaatctccaacaaaccctaatataaaatgaagtgtcccttccataactgttcttcagtcttccagttcccctacttggaaacatccaaaagtcttccacagatattttatatgtatatatgcaaatatgttcatatattcttccttaaatgatagcaatatacacacaatgttctgcacactgcttttttcatgtacccaaatattttggatcattccatatgtgtagacagagaactacttcattcttttcaatggcagcatttgaacggacatttaggttgtttcaatcttctgctattacaaataaactgcaatgaataatcttgtacaaatgcttcattttacctacacaaatatgtctgtaagatgaatg

SEQ ID NO: 53950 - DNA, 345 bp, Homo sapiens
acctcaaccaaaaaaaatctccaacaaaccctaatataaaatgaagtgtcccttccataactgttcttcagtcttccagttcccctacttggaaacatccaaaagtcttccacagatattttatatgtatatatgcaaatatgttcatatattcttccttaaatgatagcaatatacacacaatgttctgcacactgcttttttcatgtacccaaatattttggatcattccatatgtgtagacagagaactacttcattcttttcaatggcagcatttgaacggacatttaggttgtttcaatcttcttttttttttttttttttttttttttttttttttggg

SEQ ID NO: 53951 - DNA, 293 bp, Homo sapiens
agataaatctagcagcaacacagggtaaggtggctacaatgggaaaagattgcatagggggttgggaagactgttgagtgtaagcgagatggttggcagcatcagggacctgggaattcaaggtcccattgtagggatggctgggcagaatgatttaagaatccaggggttatggggctgggtgaggtggctcatgcctgtaatcccagtgctttgggaggctgaggcaggatgatttgcttgaggtcaggagttcaagaccagcctgggcaacacagcgataccccatctct

SEQ ID NO: 53952 - DNA, 429 bp, Homo sapiens
cacgtgcaaaagagcatgtatagtatgctgccttttgtgtgagaaagaaggggaaataagaaaaacctacatataactgcttatctttacaaaaagaagcttcggaagcataaaccagaaaacagtgaagttggtgacctccacgaggtggtgtgagggaatgcggtggatagaatatgggaggaagagatacatttttgagtaacttttgctaattttaacttttggaagcatgttaatattctacatatttaaaaaatcattaagaactgaaagcaaattgaacaaatttgaactcaattgtatttcaaatggatattgtaactttactgaagagagaacaaataggaacccaagtagttcacgagcacagtttttaacaatatactccattcttggatgacacaggagggagggaaagttgcaaag

SEQ ID NO: 53953 - DNA, 316 bp, Homo sapiens
cttcttacctccaaagaccacactagcatcctagcaatggttcttaacctgttcaaaatgacagaattagaattcagaatatggatagaaacaaagatcatcaacatccaagagaaagtgaaaacccaatccgaggaatctaaggaatacaacaaaatgacacaggagataaaagacaaaatgtccatttaaagaaaggatcaaactgatctgatagagctgaataattcatttcaagaatttcataatacaaatgcaagctgaggaaagagtctcagctcaaagaccagttcttcaatataactcagtcagacaa

SEQ ID NO: 53954 - DNA, 797 bp, Homo sapiens
  misc_feature (435)..(435): n is a, c, g, or t
  misc_feature (791)..(791): n is a, c, g, or t
  misc_feature (794)..(794): n is a, c, g, or t
  misc_feature (797)..(797): n is a, c, g, or t
gaatggctttgtctgttattggtcttttgtggttccatatgagttttagaattatgttttatatttgtgtggataatatcattagtatttcaatagagattccattgcatttgtagattgctttgggtagtatggacattttaacaatattgattctttcaatccttgaacatgaaatatctttccattttttggtatcctattactttcatcagtgttttacaattttcatcataaagatctttcacttctttggttaattcctagacttttatttttatatatgactgttgtaaatgacattaccttctacatttctttttccatattttcactattggcatgtatttgtccgtttcaagctgctgataaagacgtaccaagatggggcaatttacaaaagagaggttaatggacttacagttccacgtggtngggaggcctcacaatcatggcagaaggtgaaaggcatgtctcacatgccagcagacaagagaagagagctagtgcaggcaaactcaactttttaaactatcaggtcttgtaagacttattcactatcatgagaacagcatgggaaagacctgccctggtgattcagttacctcctactgggtctctcccacaacacatggcaattcaagatgagatttgggtagggacagagccaaaccatatcatgtcatatggaaatgctaataaaggatgttgaattatatcaaatgctttttcagcatcaattgaaattatcatataatttgtctttcattctgttgatatgacatagcacnganttn

SEQ ID NO: 53955 - DNA, 1394 bp, Homo sapiens
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaa

SEQ ID NO: 53956 - DNA, 1699 bp, Homo sapiens
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaa

SEQ ID NO: 53957 - DNA, 1520 bp, Homo sapiens
  misc_feature (1394)..(1394): n is a, c, g, or t
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagtttctcttctttccatcgtgtggattcaatagtttggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaancctctgccaggtctgggagtcccaggccatctgctcaacgctctgtggtttgtcagacctgcaaggcaagcccctgctggggaagcctaggtgtccttgagctgcgtctgctgaggaagcagaaca

SEQ ID NO: 53958 - DNA, 2330 bp, Homo sapiens
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaagggtttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaagatggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggcaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacc

SEQ ID NO: 53959 - DNA, 2003 bp, Homo sapiens
cacgagctcggccccagattacacagctgaaaaattatcgcttggttggaaattgaatttttaacttacataaacatctttctgatgagctccaagaacatttctatgactacagtttctacatgtttgtattatgctaagagttatttcttatcgcttttttaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaagggtttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaagatggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggcaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacc

SEQ ID NO: 53960 - DNA, 2119 bp, Homo sapiens
  misc_feature (17)..(17): n is a, c, g, or t
tatccgaggccctgctnaagggcatctgtggaaaacctaccggtagcatcatactaaatggtgctctgttaccccggctatcgccagaaaaaaaaaaaagaagaaaagaattttattacctactttgggctatatttctaagcagtccagttctgacaggactagctgtatgtactgagacacaatcagctttacatatttttctagctgtatttctattaatatcagaagggaatgcctccttcctaccactgtcatttttaaatgtttttttccctttgccttggaggaattataaagatgtcatgaggagcttggtcagctgtatcagaaatacaatgttcatttctactgttgtttttgttctctatagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaagggtttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaagatggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggcaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacc

SEQ ID NO: 53961 - DNA, 1490 bp, Homo sapiens
ggtctgactctagagctccccggtaacggaagcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaagggtttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaagatggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggcaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacc

SEQ ID NO: 53962 - DNA, 2448 bp, Homo sapiens
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaagggtttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaagatggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggcaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacc

SEQ ID NO: 53963 - DNA, 2294 bp, Homo sapiens
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaagaaagaaaagaagacagaaggcggcgcgcaccaaaggcgacccacctggcagccgcgcaggccacagcccagaaaacaatcagacagaaaggagagcggacacaccacatcaaccacgaacacggaacaaccagtccgcaacacacaccagaaagtcacccgcacaaaaaaaccacaaacaacaacgacagaacaaaaacaccgacacaagagcaaagaaaagacaaccacataacaaaaaacaatccacaaacaacagagaaaaacaaaccccaactcaaaccagcggagcgaaacaaaccccccaccacacagacacaccaacaaaaacagacacaacacacaagaagaaaagacaacgaaaacacaccaacacaacaccaaaaccagcgcaaacaagggagagaggcgaacacaccacaaaacccaccagcgcgaccacaaagaaccaaaaacaacaaacgaaccaaacagcaaacaaaaagaaaccacaaaa

SEQ ID NO: 53964 - DNA, 2326 bp, Homo sapiens
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaagggtttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaagatggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggcaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacc

SEQ ID NO: 53965 - DNA, 2353 bp, Homo sapiens
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaagggtttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaagatggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggcaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacc

SEQ ID NO: 53966 - DNA, 937 bp, Homo sapiens
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagagccctcagtgtcaatgttcctgtccttccccaccaccaagacctacttcccgcacttcgacctgagccacggctctgcccagggttaagggccacggcaagaaggtggccgacgcgctgaccaacgccgtgggcacgtgga

SEQ ID NO: 53967 - DNA, 1604 bp, Homo sapiens
agggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaa

SEQ ID NO: 53968 - DNA, 1072 bp, Homo sapiens
atttttctagaatcatctctttattgctgtctgctcagaacaatcaaaactggtagcgggaagagaatcagtgtaggaaggcaacattgacaaggccaaacaacgaagtggtgactcactgagtccttgcactctcgaaggaaacaaccaccttagaaaaaaccatgcactttcggcgggggcttaatcacattaggttctctgtgtagcatattaatgcctgccacaagggtgctatcaaccagaatcttcagtgaatcttctttgtctgaattgcacatatctcagaggagaatagagaatgtgtaaggacaccgtggcccatgcattgacactgtcatagataaagcatagttactcactatcagttctacccacagccaaagtccaggttccacctcctttagcaagccttctcgaaggactccatgcctcactgatcttcctcctcactgaacgccacagaccaagaacccataatgtcctcctcaggaaccagcacagtcccaaagtccacagaactcaaaagaacgctggtagattgatttgctctaccatcatctcaacagtgctttcctcgggtgtagcatgatgcattttaacacaattaaaatgacatgttagaaatgttgctgatggggttgctggggcaatgacttctttcaaagtcttccctctatttactgcactcatggaagtgagtctcatgggaagctatgtcttagctgaaagcctgtcttcaaagtcctttggcaaggaagttttctgttatgaataaattagtatcacaagtaaaattttcaagtgtttttccatacaattgacacttctaataatgaaaaagaatcaagcttctgactctgcacacagtggcaaatattggcatgtgtaatctggggcctgttgggtgaagatccttaagttaccacaacctattggtagagtgtctctaaattttggatgtagccagtcccaaactgacttgtaaaagtgtcagcttggacagtgtttcacaaactgggattggagaaagaccacagttctgaaagatgctgctcggtattgctcagtg

SEQ ID NO: 53969 - DNA, 338 bp, Homo sapiens
atttttctagaatcatctctttattgctgtctgctcagaacaatcaaaactggtagcgggaagagaatcagtgtaggaaggcaacattgacaaggccaaacaacgaagtggtgactcactgagtccttgcactctcgaaggaaacaaccaccttagaaaaaaccatgcactttcggcgggggcttaatcacattaggtgagtaatcacctcaaagacccaaatggcagctctgttaatgttcagtctgtatggccttctttatatgtaaatgccaaaacattaataactactaataacattaatagaatgccaaaaacactgcaggtacaaatatcta

SEQ ID NO: 53970 - DNA, 1110 bp, Homo sapiens
ctttgggaggccgaggtgggaggattgcttgagcccaggaattcaagaccagtctgggcaacataacgagaacaagtctctataaaaataaaaataaaaaccatataaaagtaggtatccatagtgctctgtgtccattagacattaataaaaggattccagttgagaggaacaacatttgaagtcattgttattccctcctctcttaattccattaatcttccatggtttcaggttctctgtgtagcatattaatgcctgccacaagggtgctatcaaccagaatcttcagtgaatcttctttgtctgaattgcacatatctcagaggagaatagagaatgtgtaaggacaccgtggcccatgcattgacactgtcatagataaagcatagttactcactatcagttctacccacagccaaagtccaggttccacctcctttagcaagccttctcgaaggactccatgcctcactgatcttcctcctcactgaacgccacagaccaagaacccataatgtcctcctcaggaaccagcacagtcccaaagtccacagaactcaaaagaacgctggtagattgatttgctctaccatcatctcaacagtgctttcctcgggtgtagcatgatgcattttaacacaattaaaatgacatgttagaaatgttgctgatggggttgctggggcaatgacttctttcaaagtcttccctctatttactgcactcatggaagtgagtctcatgggaagctatgtcttagctgaaagcctgtcttcaaagtcctttggcaaggaagttttctgttatgaataaattagtatcacaagtaaaattttcaagtgtttttccatacaattgacacttctaataatgaaaaagaatcaagcttctgactctgcacacagtggcaaatattggcatgtgtaatctggggcctgttgggtgaagatccttaagttaccacaacctattggtagagtgtctctaaattttggatgtagccagtcccaaactgacttgtaaaagtgtcagcttggacagtgtttcacaaactgggattggagaaagaccacagttctgaaagatgctgctcggtattgctcagtg

SEQ ID NO: 53971 - DNA, 391 bp, Homo sapiens
agagctaacatcaaccttcacacctatgcactttgatgctgaccctgggttcataattcacattctgttctgccttcctgccagctctcagattttcagaaacgtcagtgacatcctgtttcctaccgacacatgtttaaaattcttcttcctagcttacatagcactctagagttttatgtcatcctgcccaaccaatcatatctcccacctccctcaacacgtttccccttgtagaatgagtcagactctgccggcccctgaacgtcccatgcttgctttcactttggtgccttggttggaattctgccttattcttctaatctagtttgtcttcccgtgttcatttatctcttctagttctacccacagccaaagtccaggttccacc

SEQ ID NO: 53972 - DNA, 276 bp, Homo sapiens
ttttattgctaaagcactgccatttggggtcccaacccaagaccagggacatttgccaagccccatactttggtagaccctggactcagtcccatgagtctgacaaaagcactgtacacttgatcaaccaaccctcctgaaatgagtgaaaacccataaggcaagagtagcccacctctccagatctccatctttagccagatggtaacaccatttttttactctcttattagtcttctaagccttcaaatgtgtgtgtatgtgtgtgtgtgtaca

SEQ ID NO: 53973 - DNA, 338 bp, Homo sapiens
ttcaaaccctctccattattgacttgagagcaaacactcccagagtataaattacccttgctacattctgactctgaatgaataatatttcctgtgtagtgacatgctctacactatagacttggaattgaatggcatctgattcaggtggatttttttttttttttcctcccaaagcaagtagatggaaaaagcggtcaactctacccttgtcggagcataatgcaaatctaagtctgtggaccttgtatcataaatgaaatgctttagtaaatgtgtcaatgttttccttctgttaattgaaacttgaatgtaatatcaaacttttgggataatat

SEQ ID NO: 53974 - DNA, 242 bp, Homo sapiens
ggacatcctgcaagccttcagctgagcacatgggaaactacccaaggcccaggaaagagccacttaaaaagatcagagggaacattcgctggagcttatgcagggctgggagtgatttctgttcccattagccagattggaaaatctcataatttgcaggtaaagtgatacaagatttttgtgtcaaaagtggggcaaaatttcctctaaattcctgtagccttccttgcttaaaaaaaagc

SEQ ID NO: 53975 - DNA, 341 bp, Homo sapiens
ctctgatcatgccattgctctccagcctgagagacagatttgagactctgtctctaaaataaataaataaataaataaataaataaataaaaataaaagaaatggaaaccgtatagttataatttgttgagcacttatctttgccaggtggcctgggaagcattttatttctacgatctcatagatatctcttggcagccctctgagagcattgatatattattgctacatcacaggctcctacagaatcctgattctgacaattatcagccatgtggccttaggaaagtcacttcattttttgtaccttagctttctcatttctacatgaagaatgataa

SEQ ID NO: 53976 - DNA, 316 bp, Homo sapiens
aaagcaagattcaacagagaaatgaaatgagagctttaaggcatcagtatgtgcaggtctgcagacagcacagacagacttagaaccagaaagacgggagaagtgcctgtcccactggacagaaagcctgacccctctgggaggccactttccctccctcctggacccctcattaggcctcgctaccatctccccaaattccagaggtagtcctttgcagacaagatctactgccaggtccctcgacgcccccttgctcctctgtacaaggcaccaaaacatgggaagcaggcttcatttgcataccacacatata

SEQ ID NO: 53977 - DNA, 702 bp, Homo sapiens
acacacaccccttcatctgacacctgtggcttttaaaaagaaagccagataacggatagccatttaatcagtttgtatccacacaagcacttctccgatttccctcatgcattaggtaatgacactctcccctgagattgatatgtatattataattaataactagcgcagcgtgttctccaaaggggcagctgcaggaggaataccacagcctctgctgtgacccgcagacctcagtgggagggacatgggacatggtggctcgcactgtgttgaccagcagcccctgttcattgcatggctgggtctggttcctacctagtgggtcaaggctgatatattaaagttctgatgttttgtctcaaaaagaccaatatgacctagttggagtacgtatatataaatgtgtatgtgtatgtagcattctatattcacaagcctttaagtgatttttctaggaattaataagaagtaaaggccaggcacagtggctgcacttgtaatcctagtgctttgggaggctgaggcaggaggattgcttggggtcaggagtttaagaccagcctgggtagcatagctagactctatcgctacaaaaaaatgaaaatatttagctggccgtggtggcacatgcctttagtcccagttacgtcactccatacactccagcctgggtgacagagtaagaccctgtttctttaa

SEQ ID NO: 53978 - DNA, 374 bp, Homo sapiens
ccacacctgctttatttcccctgctttaaatagaccatgcctgctatatctcaccttctttaaatagagcatacctaattgaccttgcctgcttaatgtacaccacacctgcgttaaatcacccatacctgattgactacatgttctacataaaccacgcctgatcaatcccacctgctttaaatagaccatccctgattgaccctgcctgcttaatgtacaccacacctgctttatcccacctgctttaaatacaccacacttgattgactctacatgctctaaataaaccacacctgatcaatcccatctgctttaaatagaccgcacctgattgaccctgcctgctttgaaatagcccacatctcagtgat

SEQ ID NO: 53979 - DNA, 220 bp, Homo sapiens
tgtagctgttggaagtgggattgcctccttgatttggttcttggctaggtcgttactggtgtatagaaatgctactgatttctgtatattaattttgtatcctgaaactttactgaattcatttatcaaatctaaggtttttttggtggaatctttagggttctctagatactagatcttatcatcagtgaagaggcatccaatttggatgcctttgaat

SEQ ID NO: 53980 - DNA, 326 bp, Homo sapiens
cttgtggaaaccacaagaagagctctgggccatgctcttccctggctcctcctgcctcttcactaatgtagtgtttccctctctggccctgcatggcatccagtgcctactccctcttggaactgtggctagtaaacttctttcaatgacagtgactctctgtatcatcagtcacacctatatattaaatcccaggcacattttaaaacaacctgccttattagtaagaggactggccactcctttttaaggcttcctcctcttgaattgtccaagagcacctgaggtcaagagttcaagaccagcctggccaacatggtgaaacc

SEQ ID NO: 53981 - DNA, 419 bp, Homo sapiens
ttaatgtttgccctaaagttggctacaaagttgataaatatgaggtatgatgcctgaagtcaagataagaaaagttctaaaacatttactttgcttctacctgcaactatggagattacatttagatttcatctttggaacagctgccagttccttccttagaaaatagcagaggctagcttttggtgacacacagcatgaaagccaccatgggggtaggcgataagttggtaacacagaggcaaaagacaattagggacgattttcaaagtgcttcagggcctgcagctgtaagactcccgtggactgcacagcagtggtgtgcctacatttttcttcttcgcacagctctaaaaacataagcaatcaactcttggctgacttcaggaacccagttgcctatgtatgattcctcacag

SEQ ID NO: 53982 - DNA, 324 bp, Homo sapiens
gaaaaaacaaccataccctttcttttgaggaaaacttacaaactttataaagaataaacatgaatctgcttagaaagttccaagataacatacacaactgaatcacctcttcatatataggcaccacacacataaagatgtagcctaaatcacaatcacttctcaccagggatggagataggaatttacattcttgacttcattaagtctctaatttggcaaaaacctccaagccttttatacacatgctgcgtgtaggccagatctcactcattcttataattgtgcaaataatatggagaccaaaaggcagggttttcattt

SEQ ID NO: 53983 - DNA, 309 bp, Homo sapiens
ctcagctgtcttcagctgctagggagatttttttccccctcctgagctactgtttcccccaacccgagcctttctctcttattgtacccaccctttctgatgaagtcatcaaagcaaagattgcataactgatgcataggcctatcttgtgttatactgggagacaggccaatgtttccattaatagacaagagcaccaccacgctgccaaatggagctctctgctgcaaccactacaagacaggaagaagggaagggaagggaagctgagtgctcagggcatgctgtggagggaaggcgagggcactt

SEQ ID NO: 53984 - DNA, 484 bp, Homo sapiens
gcacactcctgccccaacaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctg

SEQ ID NO: 53985 - DNA, 1052 bp, Homo sapiens
agagagcgctgggagccggaggggagcgcagcgagttttggccagtggtcgtgcagtccaaggggctggatggcatgctggacccaagctcagctcagcgtccggacccaataacagttttaccaagggagcagctttctatcctggccacactgaggtgcatagcgtaatgtccatgttgttctacactctgatcacagcttttctgatcggcatacaggcggaaccacactcagagagcaatgtccctgcaggacacaccatcccccaagcccactggactaaacttcagcattcccttgacactgcccttcgcagagcccgcagcgccccggcagcggcgatagctgcacgcgtggcggggcagacccgcaacattactgtggaccccaggctgtttaaaaagcggcgactccgttcaccccgtgtgctgtttagcacccagcctccccgtgaagctgcagacactcaggatctggacttcgaggtcggtggtgctgcccccttcaacaggactcacaggagcaagcggtcatcatcccatcccatcttccacaggggcgaattctcggtgtgtgacagtgtcagcgtgtgggttggggataagaccaccgccacagacatcaagggcaaggaggtgatggtgttgggagaggtgaacattaacaacagtgtattcaaacagtacttttttgagaccaagtgccgggacccaaatcccgttgacagcgggtgccggggcattgactcaaagcactggaactcatattgtaccacgactcacacctttgtcaaggcgctgaccatggatggcaagcaggctgcctggcggtttatccggatagatacggcctgtgtgtgtgtgctcagcaggaaggctgtgagaagagcctgacctgccgacacgctccctccccctgccccttctacactctcctgggcccctccctacctcaacctgtaaattattttaaattataaggactgcatggtaatttatagtttatacagttttaaagaatcattatttattaaatttttggaagcataaa

SEQ ID NO: 53986 - DNA, 679 bp, Homo sapiens
  misc_feature (14)..(14): n is a, c, g, or t
cacaggagcaagtngtcttatccccaacccacacgctgacactgtcacacaccgagaattcgcccctgtggaagatgggatgggatgatgaccgcttgctcctgtgagtcctgttgaagggggcagcaccaccgacctcgaagtccagatcctgagtgtctgcagcttcacggggaggctgggtgctaaacagcacacggggtgaacggtgtcagcgtgtgggttggggataagaccaccgccacagacatcaagggcaaggaggtgatggtgttgggagaggtgaacattaacaacagtgtattcaaacagtacttttttgagaccaagtgccgggacccaaatcccgttgacagcgggtgccggggcattgactcaaagcactggaactcatattgtaccacgactcacacctttgtcaaggcgctgaccatggatggcaagcaggctgcctggcggtttatccggatagatacggcctgtgtgtgtgtgctcagcaggaaggctgtgagaagagcctgacctgccgacacgctccctccccctgccccttctacactctcctgggcccctccctacctcaacctgtaaattattttaaattataaggactgcatggtaatttatagtttatacagttttaaagaatcattatttattaaatttttggaagcataaa

SEQ ID NO: 53987 - DNA, 753 bp, Homo sapiens
atctacaagtagtccaggaagagggggagaagatccctttaggtgtgaaggaagaatggactggaaagtagagaccctgagatccaggacggaaggagggaagaggctcgcttgactgtcataagcttcattttgctgaaacagaccccagaaagggcagtgatgagagatgaggccacaatacagatatccaattatttcagcatcacttgctaaaaatactttcctttcgtctttggattccactggcaactttattgaaaaatcagataactatatggagtctttctctgtcacccaggctggagtattgtggaatctggtcagcagcccacagtgcaacgtggctctctctttgctctcagggacatggatgaagctggaaaccatcattctcagcaaactatcgcaaggacaaaaaaacagacaccgcatgttctcactcacaggtatgatggcatattcctgtggtaccagctacttaggagactgaggtgagagatacagcttgagccagggaggttgagcctgcagtgagccgtgaatatgccacttcactccagcctgggcaacagagccagatcccatctccaagggaaaaaaaaaaccactcctagatgattactctagaatagaatctatgtcctcaaggagccatgaaagggaactcaaaggatttcaggattggcaggtgtgcaggttttggcttaataaaacaaatctcagggcttgaccctgtacacattacttaaa

SEQ ID NO: 53988 - DNA, 1789 bp, Homo sapiens
gattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagcttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacattcaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaggaaatgtgcttaggactcagtcttgttttcgattatccaccacagaaaccctgagacacagagcagcttagaagtctctacccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaa

SEQ ID NO: 53989 - DNA, 788 bp, Homo sapiens
cccccttagagcattcatccaagttcagtgtgtagtgtgatggttattatagatatttaaagtatagtaagtggctgtgtaacaggagagactgctgtttacctacgtactgaagggtaactgctgcccgcgtaattaaatcagtattgtcctttcctgtcggtttgatcaattgcggtaccggtagcttcctgcttgtgactgttacctaattgtgtcaatgtacatctgtagtatgtacatgtgaaagtgcctttctattttagaggagttttagccttgctcttgtaccgttgccccgctctgtgccccacccccacctcctcctcccaattcctgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatccgtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggc

SEQ ID NO: 53990 - DNA, 2526 bp, Homo sapiens
gattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagcttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacattcaggaatgacatagcctctggagtctacaaactgaagaaactttcatctgatcagccttggaaatccaaagttaaagagcctatgtgtcctcccatcccaccgcatccgtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggctgcctttgtctgcttccagtttgatgtgcatctctgtggtgtctttgttcctttcctttcattcatcactactttctccttgacagctagcttgcattaaataatgtgaaacttttacctttaaaatatttttttatctcactttcatttcttgttcatttggaaatagggtgtcctgcacagggccctgcccatgaagctgtggtttttcagtcatggtttggaggctcaatgtgtagtcagagaaaagagtcttggcagacacttaactgagaagctgagagtgtacaagcctcctaaacatacaccagattgaaatctttcttttgagaaagactctagttaaccacggcaagcccatctttggtttcatttgaataaattgaaaaataatccttaggttatttttctgtgcttagaactccccgtgtattggtatttttctttactttttttttttttttttggagacgaatctctctgtgtcacccaggctgtagtgcaggtggtgcaatctcagctcactgcgaacctccccctcctggattcaagcgattctcctgcctcagcctcctaagtagctgtaattacaggcacccgccaccacacccagctacttttcgtatttttagtggaaacggggtttcaccatgttggccaggctggtctcaaactcctgacctaaagtgatctatctacctgcctcaagctcccaagtgctgggattacaggtgtgagccattgcatctggccaggtatttttctttaaatataaaaaaaagataacttgaggtctagcaat

SEQ ID NO: 53991 - DNA, 1590 bp, Homo sapiens
cccccttagagcattcatccaagttcagtgtgtagtgtgatggttattatagatatttaaagtatagtaagtggctgtgtaacaggagagactgctgtttacctacgtactgaagggtaactgctgcccgcgtaattaaatcagtattgtcctttcctgtcggtttgatcaattgcggtaccggtagcttcctgcttgtgactgttacctaattgtgtcaatgtacatctgtagtatgtacatgtgaaagtgcctttctattttagaggagttttagccttgctcttgtaccgttgccccgctctgtgccccacccccacctcctcctcccaattcctgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatccgtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggctgcctttgtctgcttccagtttgatgtgcatctctgtggtgtctttgttcctttcctttcattcatcactactttctccttgacagctagcttgcattaaataatgtgaaacttttacctttaaaatatttttttatctcactttcatttcttgttcatttggaaatagggtgtcctgcacagggccctgcccatgaagctgtggtttttcagtcatggtttggaggctcaatgtgtagtcagagaaaagagtcttggcagacacttaactgagaagctgagagtgtacaagcctcctaaacatacaccagattgaaatctttcttttgagaaagactctagttaaccacggcaagcccatctttggtttcatttgaataaattgaaaaataatccttaggttatttttctgtgcttagaactccccgtgtattggtatttttctttactttttttttttttttttggagacgaatctctctgtgtcacccaggctgtagtgcaggtggtgcaatctcagctcactgcgaacctccccctcctggattcaagcgattctcctgcctcagcctcctaagtagctgtaattacaggcacccgccaccacacccagctacttttcgtatttttagtggaaacggggtttcaccatgttggccaggctggtctcaaactcctgacctaaagtgatctatctacctgcctcaagctcccaagtgctgggattacaggtgtgagccattgcatctggccaggtatttttctttaaatataaaaaaaagataacttgaggtctagcaat

SEQ ID NO: 53992 - DNA, 2172 bp, Homo sapiens
gattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagcttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttggtgccccttgagccacctgtagaataatttatagcagggtcccacaatctactgcaatgatcgtgaacagttatcagtggatatagtgctccaagagtcaaattgtatccgttaagggttttctaacttttgctatcccccccgcgaccaaaaaaagggggggtttataatttaaagaaaaggaaaagaggcgtgggttggtagttgtgtccttaacattcaggaatgacatagcctctggagtctacaaactgaagaaactttcatctgatcagccttggaaatccaaagttaaagagcctatgtgtcctcccatcccaccgcatccgtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggctgcctttgtctgcttccagtttgatgtgcatctctgtggtgtctttgttcctttcctttcattcatcactactttctccttgacagctagcttgcattaaataatgtgaaacttttacctttaaaatatttttttatctcactttcatttcttgttcatttggaaatagggtgtcctgcacagggccctgcccatgaagctgtggtttttcagtcatggtttggaggctcaatgtgtagtcagagaaaagagtcttggcagacacttaactgagaagctgagagtgtacaagcctcctaaacatacaccagattgaaatctttcttttgagaaagactctagttaaccacggcaagcccatctttggtttcatttgaataaattgaaaaataatccttaggttatttttctgtgcttagaactcccacggtgcatgaacacaccacgg

SEQ ID NO: 53993 - DNA, 2381 bp, Homo sapiens
gattacagatgtgagccaccatgcccggccattccaccacttctttaaaatagtaagaattcttaaaaaccatattccttgtttgatggaagagtaagatgttaacagagggcatcaaagggccagaggtgtctttgaatttattttttttcaatgtcttttctgagcttcagccttagcttttcagatcttcctcctacctgttcatttattcagccttctatctggtcatcctccccagcggctcctctctctgatgtgtccacctacggtggaacgaggattgcctttctgtgctccccatcaggactttgctgtcttggccggcaggagtcgtgctgctgcagagcctcacaggctgtgccttgtttcaggaaacagctcctaatactctcccatcactcactttacctgtctccatcttatttccctatactcctattgtcagcttgagactttttttttttttcaattccaaatgaagggtatgacctcagagtgagtgaggactcagtaaagactcacctctccttacttggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagcttttgatggtgggtaaataatggctctacaaagattacctgactccactgacacaagaatatgtattctcagctgatataactgtgtgttcacatcccatccatagaactcactgaaggagattcatcaagtcagccttttggactgggttggggtttggggagtggatttggggatagagagaaaggtgtacttagtacacattttctaatgggcgttacgtgaactgtttgaacctgctgagtggcgctttgtagagctccatgttcacgttcagtgtcaacaccattcaacagctttgcacatcttcgtacaacataatctggctttgctgcccactcgagtgtttcgaagcttcctccctgtcccccaccttccccatccccgccttcctgtgcctcggtgctcagtaatgtcccatctcacctccctgtcggtcctcagactgtctcgttttccttgtagacgtgattgtgcctttctcacccctgtgtcctcccatcccaccgcatccgtcccccgctcatgtgctgctgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattacaggcttcagtatacagtcaggtttgttcttcacggtgtatctttataataaataagatagttctggctgcctttgtctgcttccagtttgatgtgcatctctgtggtgtctttgttcctttcctttcattcatcactactttctccttgacagctagcttgcattaaataatgtgaaacttttacctttaaaatatttttttatctcactttcatttcttgttcatttggaaatagggtgtcctgcacagggccctgcccatgaagctgtggtttttcagtcatggtttggaggctcaatgtgtagtcagagaaaagagtcttggcagacacttaactgagaagctgagagtgtacaagcctcctaaacatacaccagattgaaatctttcttttgagaaagactctagttaaccacggcaagcccatctttggtttcatttgaataaattgaaaaataatccttaggttatttttctgtgcttagaactccccgtgtattggtatttttctttactttttttttttttttttggagacgaatctctctgtgtcacccaggctgtagtgcaggtggtgcaatctcagctcactgcgaacctccccctcctggattcaagcgattctcctgcctcagcctcctaagtagctgtaattacaggcacccgccaccacacccagctacttttcgtatttttagtggaaacggggtttcaccatgttggccaggctggtctcaaactcctgacctaaagtgatctatctacctgcctcaagctcccaagtgctgggattacaggtgtgagccattgcatctggccaggtatttttctttaaatataaaaaaaagataacttgaggtctagcaat

SEQ ID NO: 53994 - DNA, 411 bp, Homo sapiens
gaaagaggggaagagccggggtatttcttcctctctttttctgccttgagaggggtctccactactgttcagatagcttatatcagataactcataatttggttcagtgattaacaaaaaaatcttttttactactataacatgggcaaatttcttcatagaagcatttttattcttgttctttcctgaccataaatatgaatgcctagctttgcacattgtagttatatagattatctaatctcattgatttatgacaggttgttttacatttgcaaatggttgctgtaagtaatacgcagaggaggaagaagctagcttgtgactttctctttctctctttcctttttctttccctttatctcttttgccctttcccttgtaaaaataaaacatacagaaaagtgaaaa

SEQ ID NO: 53995 - DNA, 918 bp, Homo sapiens
cacccatcccatagccaccctggtatcagggccctgccagcagagtagcttaggcttttcctagccagagtcttctttcagccacccagggctacctagttcctggggactctagatataaaaagaagccctggccaagaaggcagaaagtctgagttcagatctgagctttaccacagagtggctctaaaccttcatgttcaactgtacaatgggactatccgtcctatccgcctctcaggtagatgaaatggggtaggcaatacgaaagagctgtgtacattgtcaagagccctattcatatgtggcctgcttaatggctccctcctagtctgatttgagatgagcattctttcagcagcatttaatgggctaagtcagatacattcaaatattttttgaactattaatgtcaatgaaattttacacagtctctccatatataaagtaaatgaaagtagggctgcaagaatcagcaggaagaggggagctagagacttcccccaataccacccgacccatcagcctctcatggcagcatccaaggcctctgcacagacccctagggctcccagcgaccaggtgcaaaaagctctagaccagaccatgccaaaaggctcattcctggctactggcagcattaacagagagcagtagaagcatcatgcccctcccagtctgccagttccttaaggaaggaccttgagaggggagagaaggcaacttgacagcatggttcaaatcaaagaggcaggaaaggggctgtcatcaggggcttggaggggactgcaaaaagtgcctacagatgaggcgggaaatttgggcaaaggttatcaaggccacgtttaattatcctttccaagtcttgcccagcccagcctttctgcacacatcatgcaaaagaaaacctccagccag

SEQ ID NO: 53996 - DNA, 331 bp, Homo sapiens
tgtcctcacccatagagctatcagagggtgcctgctattggcagaccctttacatttccctttaataaatcacttccctgccaagatctctgtcaaggtttgagaagtcagagcattaagttattttcaataaatggtatgtacatgaacatcagcaagctccaagaaatgactcgagggccttttactactcagagaataaagcaaaaatgccaggttttcagtgcttgtgctttgtgccagggatttggacgtgttttttgttaagttccagcgttgagctatgttccagaagatggagccttccagaaattattgtagtgcttgatgt

SEQ ID NO: 53997 - DNA, 415 bp, Homo sapiens
gaaaaaataatagttgggtaggcataacatttaccagttcatggtgtaacacatttcttattttatgaagtgagttttgtcttcctacctttttatttttctgcttatctgtttcatctacttctcaatagaattttgttttagatagaatacaatttgtttatattctaaacctaattttccctacttacatttttttcatggcttactaagaaagataagtgtgaccttttaatgtttctgcagaaacgttgaatgactggacagattaatgcagaaattatcacttcttcactgtatcccagatgcaaatctgctttaactgtgcaaatagtcttcaaacttctagactcacaggttctcttagtgaataatctatgaccaggatcccctggtgccctcaggcctttctcct

SEQ ID NO: 53998 - DNA, 1566 bp, Homo sapiens
ttctaatggtagattgaaagtccaaatgcactttttccaggtggcatctttggatcttctgtgtctcttcttttaagaacaatgcaaatgtacttattgattatcaaaaacgaggatttttttaagtattcataacacacatttaacaccttggtgtcctgggccccagagttcctttgaaggcccataccaatattttcaatgtaaaactcagtcttttcagaagaaaatacagtatatgaatgttttacgataacattaattacctgattttcaatacagttatgactgaggaatgatatttctaagggcacattttgaaaactccataaatcgtattgtattaacaccttaatagatacaatagtaaaacttaagaatttttctctgtcatgtgaccctctgttcctgcagttttggggttcattaaaagcacaaataaaacaatttaatctctttgaaataaagtaataaaagtaccttttagaagttttctttttcccttgtgtataaaacttctctatgtttctgtaatgaacacataaatttccatactttttcccttaactggttattttcttaaaagtcagaatttaatatggcgtatttcttttttgcccctcctgccccccccaccaactgatattatccattccataggccacagttatttctctaggcctgcatagcgacattttcatactactttaaaactaagtgggttgtgcacagtatcaaaaacctttctaggtaaactctgagcgagctatctaaactccctcccagcttgggaagcacatactaatggagaagaatttctgttctaattagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggtagatgactcttgttaattcttttcccacagtttcatacctctaattatcaatgacatgtgtatttattctctctggcttatgaccctacttttctttaaagataatttattctggacccagtatggtggctcatgcctgtaatctcagcactttgagaggctaagacgggaggattgcttgaatccaggagttcaagaccagcatggggaacatagtgagataccgtctctacagaaaattaaaaattcaccaggcatggtggctcatgcctgtggtcccagctacttgagaggctgaggtgggaggattgcttgagcccaagaggttgaggctgcagtgagccatgattatgctgctgcactccagcctggacaacagagtaaaaccctgtctcc

SEQ ID NO: 53999 - DNA, 4349 bp, Homo sapiens
gtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacact

SEQ ID NO: 54000 - DNA, 4442 bp, Homo sapiens
gtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacact

SEQ ID NO: 54001 - DNA, 3113 bp, Homo sapiens
gtaccgcgggtctgagtcgtgactggagagtaaattgtgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacact

SEQ ID NO: 54002 - DNA, 921 bp, Homo sapiens
tcttcattcttgtgttttggtgcgtatttgaagttttcaatttaaaaagtatttaggaagattggggaacccatgcctggatcaaaccagtgtacacatttgtatatacaataagatacatgcatatatataaccttatctaaaaattccattgcttttactaaatggtattatactcagtgtattaaatggtaattggggatggagattggtagcatttagggacagtacatatgactagaatgttttcttcccctcttcttagtataatgatcttaggtgacctggaaagtatcttaccttatttgatagtcttccatactgttagaaaacaggtaatggatgttatcaggtaattgctgataaatgtttgaaaattagttttttgtaaggacttagtgtatcatggtacagctagagtgtggaacctattttttatttcacccttagtagctttgcattttgtatggaaatgtttaatagtagttgctatacattttttaacatcaaagaaatagttcatgattatggtaagtactttggaagatatccttttcagtatctttttaaatgctaaaatacctctttttcaaaggcattttaaatagaagaaggagaagaaggctctatgctcatcgtgataaagtggagtttttaggaaagtaagctttaagctgcttttaccagttgaactccaaaaataatgtaggagagagatggctttctttgtttttgtttcagtggcggggcaaggtagaagaaggtggctttttaaattatttaggtgttacgttgttttaactaattttgagcacttggtagacagaggagaacaaaatgtacattaaagttcacctgtcaaattttcatttgtagagggaaggatggaggttctaaataccagcaatcttaaaaaaaaaa

SEQ ID NO: 54003 - DNA, 401 bp, Homo sapiens
tcttcattcttgtgttttggtgcgtatttgaagttttcaatttaaaaagtatttaggaagattggggaacccatgcctggatcaaaccagtgtacacatttgtatatacaataagatacatgcatatatataaccttatctaaaaattccattgcttttactaaatggtattatactcagtgtattaaatggtaattggggatggagattggtagcatttagggacagtacatatgactagaatgttttcttcccctcttcttagtataatgatcttaggtgacctggaaagtatcttaccttattttcaaacatttatcagcaattacctgataacatccattacctgttttctaacagtatggaagactatcaaataaggtaaggtcgacgcggccggc

SEQ ID NO: 54004 - DNA, 1529 bp, Homo sapiens
aagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgt

SEQ ID NO: 54005 - DNA, 588 bp, Homo sapiens
tttaggctttaaacttgagtttattaaaagggaaataaatgctttggttactaaatgaactgattagaggaaggtattacacagaaagctacttggattattactaacatcaatgtcttctttttctaaaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattaggtgatgtgcatgtatgtgtgtgactacgtctcccactccttctccaccacccagccctgggggcaagcaagcactggtccataaacatgccagcatcaactgggagcctcaaccagtcaagttacagagaccataagcatcaccttcctggcaatctcctggccatttctccccctctcctcattggctgctgaaattttagtaatgcgttatcacaaagtatctctttgttaaaggtggaggcaattcctaatgatcctacaatatacataggagtatctttcctgagagtttatttttcaa

SEQ ID NO: 54006 - DNA, 417 bp, Homo sapiens
atgtatggaagtaaaattaactaaaagagcatatatgttccagattggaagtgataatgtagtaaatattgtcttttatattccacaaacagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgt

SEQ ID NO: 54007 - DNA, 2160 bp, Homo sapiens
aagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaatggtgcagtgacattcc

SEQ ID NO: 54008 - DNA, 1552 bp, Homo sapiens
caggattacctcttcacttgtgttgcggagacagtacggatgtcagaggggtgccttgggcaactctgggactcagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaatggtgcagtgacattcc

SEQ ID NO: 54009 - DNA, 1896 bp, Homo sapiens
aagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagtaagtatactttcctacaatgcatgtctttctcctatgtcaactaattttctattaatcatctgtttaaagtcaaaagagagaagttgggttatttgtgtaggtttactctcacaagaagttactcaagtttatcaagaaatacatctgtattaggctgttcttgcattgctgtaagaaaatacccgagactgggtagtttattgtaaaaagaggtttaattggctcacggttctgcaagctgtacaatcctggcaccaacactgcttggcttttggggaggcctcaggaagctttttactcatggctgaaggcaaagcgggagcaggcacgtcacatggcaaaagcaggagcaaggttggggaggtgccacatacttttaaacaaccagatttcaagaaaactcagtcactattctgaggacagcatcaagggggcggtactaaaccattcatgagaaatccgcccccatgatttaatcggctccaacaaaccccacctccaacattggggattacaattcaacataagatttgggcaaggcaaatatccagactctatcaacatcccacttcacacttcatacctacttgtaaatggtagtacagagagaatgatgattacccagcctacttgtaaatggtagtacagagagaatgatgattacccagacaagaaatatggtcactaatt

SEQ ID NO: 54010 - DNA, 1385 bp, Homo sapiens
gtttgggagtggtgatgggaataagtggagaggttggagtgtttggaattttaatatttgatatgcttatttgattccaagtagaggttatcagtaactgaatattcaaaatctagagtttggggaaataactggaaatggaattgtaggagtcattggtacatgaaatatgggtgagctccccaacgccctgtagtttgtgtgtacttgttttatgactgtccttcttgtatgtacagatctggcagacctaactttggctctatgggcgtagagagaagatggatgacaaactatctgaggctatggcagctgggagtggagaagatatactgaagccatggcttcagacagtttgtcatctcctaattcctttgaagaatcatctgccattgacttcctgttcccagatttctggctcaatcctggaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaatggtgcagtgacattcc

SEQ ID NO: 54011 - DNA, 2043 bp, Homo sapiens
accggggggcgtcaggcctcgctggggattcagtggctgagaccccgagactcggagccggggcgcgttacctgtgctcgatacctgggcgcggtcacctacccagaggtgcagggcccccagggcggtcggcctgccgcccaccacgtaggctctgcagggaaacagagttccacaggcgtcgttgccctccgccttcagccctccgcgggttcgatcccggccacccaggtggaagtgccgcctaaggtacaaatatgaccctgcgccacgatagatcgaccgtctccttggcccaaatgttacactcacaaccactgcgccaggaaagtatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaatggtgcagtgacattcc

SEQ ID NO: 54012 - DNA, 2117 bp, Homo sapiens
aagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtttgtggccttggtgtatgctatgctcagaggaaaggctacttttcaagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaatggtgcagtgacattcc

SEQ ID NO: 54013 - DNA, 1079 bp, Homo sapiens
aagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattaggtgatgtgcatgtatgtgtgtgactacgtctcccactccttctccaccacccagccctgggggcaagcaagcactggtccataaacatgccagcatcaactgggagcctcaaccagtcaagttacagagaccataagcatcaccttcctggcaatctcctggccatttctccccctctcctcattggctgctgaaattttagtaatgcgttatcacaaagtatctctttgttaaaggtggaggcaattcctaatgatcctacaatatacataggagtatctttcctgagagtttatttttcaa

SEQ ID NO: 54014 - DNA, 316 bp, Homo sapiens
gtgaactcagccccttctctgattctgcatcccacaggcagagcttggtgggggcaatgatgacagacactagctgccacactcacaggcacacacacggtatccacacagcagtgcacacatgtaaacagcagtgtacatgcacacaagcacgtgcacataactttaagctcacatgtgggtacacaacacagtccatacacatagaagtccacatgcacagcacacacacgcatagcacactcatgcccacaggggtgcatgttcacacacacacacacagccctgccatctctctgcatccgtccagaactcg

SEQ ID NO: 54015 - DNA, 711 bp, Homo sapiens
gggaggtgggagggccgcggagatatcttccctttgtacagggcattcgtgttgtgaacccagagctgggtagaagctgcttttgtattcagtgtgaggtggtgtttacagacgactttgacaacagtagaagtgtactcagtggtgtctgtgtatctgaactatttaatttcgtgttatgtttatatgcagaaatatttatggatactacaccaagtgtttatttaatgttgataaatatgactcttcagtcgtcagccatggtgtcctttcaaagtgattctttaaggtccacttgagcaatgaatagagtatattggagctttcctgtggctaagaagaagaaacatgtcatcctgttggcatcaccaagcacctaactctttctaggtaataaaaagtcaacggtcacttcaacgtaaatgtttaaaaccactctttagttaaatctgatgggaactgaacaaagctccaccattgtgtctgaaatcattttacacagggaaaaaaaaaaacaatcagcataattgtaagaatgatttttttgggcccacattcaaccaaagaacaagaaagaaacagacgattttctaatatgtacacagcaaactacagaatgtcatattatccacctgtgaaacatctagtaagcaattgcatctatattttatttctcaagttggcctggcactaataaatatgtgaaagctt

SEQ ID NO: 54016 - DNA, 583 bp, Homo sapiens
tttttttttatcttgaaaagtaatacagtgagtgcgagtattatttcttgccagcgggtggaagatgaatgattttgtcacagttttactgcttgatgagcagtgtcctgagggtcaggcttaagtctgtgtcactatgctgctcattactcttgagctaaataagggctgattggatctaaattgcctagcacatgggccacagatgagctcagtgagcaggggatgacctgctattcagtctgggagtaaccccggtgtgcaaatgcagcattagaacactgtgggagaatgagaggctaccggctgctgccagcaaaagaaatcgaaatgtaaaaactctttgatgctgtgatgttagaatttgaaatgtaggaagtgacaggttgatggtacttatcagctttggctggattagagaacagtgtcatcttgcttatataatgacagaagaatgaagtcagcagctaactactgtgcagagcagagccgctgctgttgccacagccagtcattgctgcctcctactggcagttttcctggaaactagtaaaatattataaagaaaaaatcctccttgttg

SEQ ID NO: 54017 - DNA, 484 bp, Homo sapiens
agagtttaattctcaaaataaggtactttatgttaacatgaagaagtttagcaacaatttcattatctggaaagactgaattatataaagtatgtggaatgagggtaaaaaagagcttaaagaaaatagctccctctttgattttggtatttcctagccaagtactttgccaccttacctgtttttactatctatctggcattttgatgaacttttccccagctaaatcgacgaatcggctctcatgttgcatcccagtgtagcgtggtgttgcctgctgctctggagtcctttgtgactcacccctggtgattaggggtccacattggtgggtcaaggtgtgtattggatggggaacactggggaagaaaactaacttttcacctgttactctttctttctgttctcttagactacatgtttatataaagtgtttgaattttagaatgtaaaaaactcaattgacttaacaaaatctgtctgg

SEQ ID NO: 54018 - DNA, 758 bp, Homo sapiens
agctggcgagtgtaccctttctgcagaaagtaaaaatgcccttgctgaggaaattaaatttatgttcaagtaaatttctttatggcactgggaaacaagcatttctaacaatttggtggaaatccgtacatggatacgttctcttctgggggcggtctccagtcctttctcatgagggagcacactcctctgcctcattgcagtggcctcagggatatggaattaagatccacctggtgtgatgaataaacccagactctcagcaacgcaggaaaaaaaaaacaaaaacgggctggcgatctggagtaaaggatcctcacatccacgtgaaccaggaaactctgtgcccaaatcgacgaaaaaaaaacactgggagagccgaactaaaagtcttttagcacgggtaccagccctagaatttccagtacaccagcagcagcctggaaaccacatcctcatcaaaagacagaaagaaaaaaactcgagccagcctgagaaggaccctattttatgctgttaacccactgagactgccatcctcacagctgagaaaggatggacccaccatactcaagtcaagaaaacatcttccctcgtcagaatcatgggttactgtactaggattaagccttactaagttaaagttaaagaaagcttaattttcatataccttctatatggcttcttttcctttccttattctgttactagctcctttgttattaatgtaactaagtctgagtcacctcagaccattg

SEQ ID NO: 54019 - DNA, 613 bp, Homo sapiens
ctctgcgctctcatgataggtgtcctgggatgattacccttaacctaccaaaggaactatgttctccaattagaattggttttatttagagtaaaggaatgattttggtgacagcaacatcaaagaatggatctgcagcaaagtcatgaggatctgataagctttatgattgattaacaacaggttaaaatcaaagaacagatttcatgtgtactgtgtttttagatgtatagagcaacttagctgaaaaattacccagaacttttattctataggttttcaggtttcagttttaatttaacatatatacattgatttagtcatgtatcattcagacattattgaacacctattgtgcagatattaggcttaggcttataactggcaaatctctacttcctgtctcctttcctcctggatacatcatagatagagatgctgcagcctgaaactccagattatatcattttccaccactgattttgcagaggtaatgcatgctccttattctgccgaagcaactagttgagagagatataaatactgctcagctgatcagctgtatcagtgctattaccaaacagaatccagagctgatgagtgttctgttatt

SEQ ID NO: 54020 - DNA, 1961 bp, Homo sapiens
gaaagcgagggagggaaagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaat

SEQ ID NO: 54021 - DNA, 1608 bp, Homo sapiens
gaggcactgcttggaagcaattgtagagcaatacagctcttgacaaactcgtgtcgaacatcagtgactgttgaagggaatgaggcaaacatatctacgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaat

SEQ ID NO: 54022 - DNA, 1716 bp, Homo sapiens
ggacgcgtgggtcgacccacgcgtcgggaaggagcgcggagcccggcccggaagctaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaat

SEQ ID NO: 54023 - DNA, 1737 bp, Homo sapiens
ggacgcgtgggtcgacccacgcgtcgggcagaggaggagggagggagggaaggagcgcggagcccggcccggaagctaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaat

SEQ ID NO: 54024 - DNA, 1634 bp, Homo sapiens
gtctcattatattcaaatattccttttaggagccattccgtagtgccatcccgagcaacgcactgctgcagcttccctgagcctttccagcaagtttgttcaagattggctgtcaagaatcatggactgttattatatgccttgttttctgtcatcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaat

SEQ ID NO: 54025 - DNA, 1684 bp, Homo sapiens
ggacgcgtgggtcgacccacgcgtcgggcagaggaggagggagggagggaaggagcgcggagcccggcccggaagctaggagccattccgtagtgccatcccgagcaacgcactgctgcagcttccctgagcctttccagcaagtttgttcaagattggctgtcaagaatcatggactgttattatatgccttgttttctgtcatcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaat

SEQ ID NO: 54026 - DNA, 1753 bp, Homo sapiens
ggaggtaccatgctaacaggaacagcaactgtcgcgtgatgctgcagtgatcaaacattgaggagccgattccgtcagtgcactatcccgagtcaatcgcaactgcgggggagacttcctctgtgagcctattactcatgcaaagttggttgcaagattggctgtctacacgaatcataggcacgtgtatatgtatatgcctgtgtattctgtcatgacgagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaat

SEQ ID NO: 54027 - DNA, 468 bp, Homo sapiens
aacaccgtgaggagcttccaccacgaaggtcagtctcttcccccagtctgcgtgggggagggctggtgggactggctagaggggcagtgaaagccctggggaagaagagttcgggttacatcaaagccccagtccaggaggctgaggaacagagctgcttacctccaagaatttgcagagctgccgccgaacttattttttggagacagagggggaggtgttcaggggaaggggaatgacagcactcagacgtgggctagccccagcggtgtgtttttgctatatcaaagccttttctgctaggttttctgcccgtttttttcaaagcacctactgaatttaatattacagctgtgtgtttgtcgggtttattcaataggggccttgtaatccgatctgaatgtttcctagcggatgtttcttttccaaagtaaatctgagttattaatccaccagcatcattactgt

SEQ ID NO: 54028 - DNA, 1752 bp, Homo sapiens
gaaagcgagggagggaaagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatagttcagcgtctgacggcgtacgcgacatcgatgt

SEQ ID NO: 54029 - DNA, 1709 bp, Homo sapiens
gaaagcgagggagggaaagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatggtccgcacagggggatcctcggagt

SEQ ID NO: 54030 - DNA, 1701 bp, Homo sapiens
tgctaaaggagcacaatgcctgatgctgcaggagaaacattaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaat

SEQ ID NO: 54031 - DNA, 1584 bp, Homo sapiens
gaaagcgagggagggaaagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccaccatgcaagttcgggactaaccagccatgcaagttcggactaaccagcatgcaaggtcgggctaaccagccatgcaaggtcgggactaaccagccatgcaaggtcg

SEQ ID NO: 54032 - DNA, 209 bp, Homo sapiens
cccaccttattattttatgatcacataatattctaccatatgactatattgacatttattctttcttttgatgtataagtacaaattttttttattaaaagagataaagattcattaagactctttgtgcacatgtctataatgtattaaaggtattccatgtcctctagaagtagaatgccatgttgaatgctatatacctttaacat

SEQ ID NO: 54033 - DNA, 400 bp, Homo sapiens
cttatttttttttattttttgtagagacagggtctcactttgttgcccaggctgggacactgatatttgagtttcatgtaatttccacatgtcacaaagcattcttttgctttttttcccctaaccattaaaaatcacaggtcatataggccaggcatagtggctcatgcctataatcccagcattcgagaggccaaggagggaggactgcttgaagccagaagtttgagaccagcctgggtaacaaaccaagaccctatctctactaaaaaaatcagtcaatcaggccagtcatggtggctcacgcctgtaatcccagcactttggaaggctgaggcgggcagatcacctgaggttggaagttcgagactagcctgaccaacatggagaaaccctgtct

SEQ ID NO: 54034 - DNA, 5293 bp, Homo sapiens
acagacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtgggctactccagggaacaacacggattctcgtgacgcacgcactccacatcctgccccaggctgattggatcatagtgctggcaaatggggccatcgcagagatgggttcctaccaggagcttctgcagaggaagggggccctcgtgtgtcttctggatcaagccagacagccaggagatagaggagaaggagaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcagagcctgtatgtggttagctcatgccagctgagacgcttggagtcagccagctactcgtctgtctgctcccacatggctgagacgttccagggcagcacagtggtccgggcattccgaacccaggccccctttgtggctcagaacaatgctcgcgtagatgaaagccagaggatcagtttcccgcgactggtggctgacaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctgagccaggaccctcaaccgtaccccagttggaccagcccgcacagcctgcagtgctggagatggaagtgacccgtggtcatcgatagctccacacgatattgagtctagacctgtgtttgctctctgggaggaaaatggcagagaaagtggccaattatcacagagcatcagagccggaaggacctagcaatacacaggtctgcccgggcagggcccatctcgccctgtccaccctgcagccaatgtcaacagcgactctcagccccgctgtactctggactcacctgggggcctcaagcacatgcccaggctcccggctagacccttaaatcagaatctctgaggctgggaactgccatgctgtgtgtactttttacaaattaacacttttattttgggataatcccagactcacatgcagttaaagaaacaataatatagagagattcgtgtacttggtaccccatttcacccaatggtaacatcttgcaaaactctaggataaagcatcacagccagggtgttgacattgacacaacaatcttgctcgatttcccgttttacctgtaaaaaaaaaaaaaaaaaaaaaaaactcgagttaaagggtttattgaaatgcctgtggataaattatcatcagcttaaaactgttttggggttttaaacagggggtcttttgctcttaaaatgaaaggaagctttgcaggtccattgtccaataggaaaaaaattttatttctttggtaa

SEQ ID NO: 54035 - DNA, 2777 bp, Homo sapiens
acagacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggcatccacagcatatctgaagaaatattcagaagttaactaatctcagatgatttcagcaggagtaaagaagagaaacagactcagaaatgccattacaacagttaattatgtcaaatttatcaccctgattgatcacgcagcattaacctcaagaacgccaagccaagtttttttgacaaatgtgagccaaggtttccgaaaaactagcagatatgactgtgacttacaaaatggaaaaagtaaacgagaaacacaatttgatatgatttaataaaagatttgtttccaccacttctcctgggaacctcagcacattttctttccactgacagttattatctctacctttattgaacaaagacacccggaacacagctgctgaggatcagtaaagaaaatcattcttttattaataagactgttattagcaggaaaaaaaaatccatgtttgggagtttgcactgaagttacaggccattttgaagaaatatggctgactagtgccaacattatttcaggcaatttcatgatcaaatgtcttattaggttgtttaaaatttttatagagattgtaaatcagaactattttctatttgccctaaatatttagatgctacagggaaagcagatcaaattaaagggtactgtgcacatttttttactgggaactcccagggatataaatcatttcgcctgcagcatgggaattcttcagtacacatgcttgtggaaacattccacgctccgccagcacgctcattaaagtgatgatttgggttgcaacaacagtgccaagtacttcctgtgttcaactggggaccatgtggcaagacccaaagcttccccagagatcctatgggaataagttttttgagccaccatattccattatttcagcctaaaataacaccatgggacaagaatcagaagacagaggagcagacaaatgtgtgtagacatgctggaaggaatctttctttttagaaacagggtcaatatctattaaactttaagatgtgtatctcttgacctggcagtttctgtatttgagttttaacctactgatatacccatgcatgtgaataaagtatcttcctgcatgtaacaggatatttaatgtaaccttgattatagttgcaaatgctgggaaacgatccaaatgtctttcaatatggcactgattaaataaattatggcacagtctcacaatgaaaaacaaatgtagccattaaacagaatgaaatgggtctagctaaattgaaataggactacctctaagatatgttgttaaaaagaaaaaaaagaaagtgcagaggaacaagtatgataccattttgtattttttaacatatgcaagcgtgattgtgcccacacagaatacctttgaaaataaactcagtatttgcctcagtggataaaaacaagaaccagccttattttcactgttatatcttttggtgccactttttgaactttttaccatatgtgcatatgtaactttctaaataaattttgtaaaaaagagaaatatggctcgttgcaataaatctaacaagataaaaga

SEQ ID NO: 54036 - DNA, 3023 bp, Homo sapiens
acagacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtgggctactccagggaacaacacggattctcgtgacgcacgcactccacatcctgccccaggctgattggatcatagtgctggcaaatggggccatcgcagagatgggttcctaccaggagcttctgcagaggaagggggccctcgtgtgtcttctggatcaagccagacagccaggagatagaggagaaggagaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtaaccaccagcttcacccacccctccccacccactgtgccacctccaggggcccaagtcctcccaccaaatgtagcacttggcagtgatactcacctttcttgagcacctactatgtgccagtagcattctagatgttcattttcttaatcctcacaaccaccctaaaaaatagatatgataggtctatttcagacataa

SEQ ID NO: 54037 - DNA, 465 bp, Homo sapiens
tttccataaatgaccagattgtgcatattttaggcctgtgggccacacagtctctgtcacaactgctcaaagcatgaaatagagaaatgaatggatgtggccgtgttccaataaaactttatttataagaaaaggcagcaggcaggatttggtctctgggccacagtttgcctccccctggattatgtagccatgggacacggacagaacaagaaccctgcggggtcacccacaagccagtgagtagcagggcaatttgttcagtgggagagatttcttcctgcagcctctgcccctggggggggcgggggatggtgcctgggggcctctccgatgcagaggccggccaggtcaggggtctcctgtaaatggcctcttgtgccctgcagctgccgggaaggattgcatcaccatacacagtgccaccttcgcctggtcccaggaaagccctccctgcctccacag

SEQ ID NO: 54038 - DNA, 492 bp, Homo sapiens
tctctgatcctgtctactcacctgcatcaagccagtttgtacaagctgatgtctgagggcttctttttgctctgcatgctctggttctactgaaggaagagagggacctgttggttgtatccaaatcccaatcccctgggcccaggtcctcagactgtcccattcctgcctcccctctttactcccctgggtctggcctcccagaaaaggttgggaaaccaggggggctgttgcaagccctcaagtggccttgccaaacccagccagagaggctttcttgcaccaggtgacccagacactgcagtgggttgttcgcaactggacagacctagagaacagcatcgtgtcagtggagcggatgcaggactatgcctggacgcccaaggaggtgatgggcgggaggtggggagggggtcccagcaaggacatattgtggggggggcaatgggtccctgttgacatctgctacaggctttggagtttataccctct

SEQ ID NO: 54039 - DNA, 724 bp, Homo sapiens
acagacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtagctgccatccctgggagcctggaaccaggcaatgttcgggggaggcaggggacaggctggaacctggtgaagtcttaaagtagactcctcctatcggggtgtagaagggaatctgttaatcaaacagagcaatattagaaaggctacagaggtcaactcagtggaacacggttctcccaaacagattttgtaattccgaaaatccacgcatgcgcaaacatacgcatacactcccatgttcctggacagtttatagctaccataacctggcattttccaaaacataccatgtagactcttggatacacaaggtaattttagagccacattaggatgaaccttttaaaaagttatgcatttatttttatgttcccccactggctgtattataggacaatttttatatgtgatatgtatttaccttagtgtgttaaataaacactggcattccaagtgtaaaactttct

SEQ ID NO: 54040 - DNA, 2224 bp, Homo sapiens
agcgctagcgcagcagccgggcccgatcacccgccgcccggtgcccgccgccgcccgcgccagcaaccgggcccgatcacccgccgcccggtgcccgccgccgcccggcaccggcatggcgctccggggcttctgcagccgatggctccgacccgctctggccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctgagccaggaccctcaaccgtaccccagttggaccagcccgcacagcctgcagtgctggagatggaagtgacccgtggtcatcgatagctccacacgatattgagtctagacctgtgtttgctctctgggaggaaaatggcagagaaagtggccaattatcacagagcatcagagccggaaggacctagcaatacacaggtctgcccgggcagggcccatctcgccctgtccaccctgcagccaatgtcaacagcgactctcagccccgctgtactctggactcacctgggggcctcaagcacatgcccaggctcccggctagacccttaaatcagaatctctgaggctgggaactgccatgctgtgtgtactttttacaaattaacacttttattttgggataatcccagactcacatgcagttaaagaaacaataatatagagagattcgtgtacttggtaccccatttcacccaatggtaacatcttgcaaaactctaggataaagcatcacagccagggtgttgacattgacacaacaatcttgctcgatttcccgttttacctgtaaaaaaaaaaaaaaaaaaaaaaaactcgagttaaagggtttattgaaatgcctgtggataaattatcatcagcttaaaactgttttggggttttaaacagggggtcttttgctcttaaaatgaaaggaagctttgcaggtccattgtccaataggaaaaaaattttatttctttggtaa

SEQ ID NO: 54041 - DNA, 388 bp, Homo sapiens
gagaggtgggccacggggagcagattcctatctgatgggttatttgtacctaatgtacaaccggggtctcccaactggggcccgggagtggtttagaaagcacaatgaggtcggatgcggtggctcacgactgtaatcccagtactttgggaggccgaggcaggcagatcacaaggtcaggacttcaagaccagcctggtgaatatggtgaaaccccttctttacaaaaagtaaaaaaattggccgggcatggtggcgcgtgcccgtagtcccagctactcggtagactgaggcaggagaattgcttgaacccgggaggtggaggttgcaatgagccaagattgcaccattgcgctccagcctgggcaacagagtgagactccatctc

SEQ ID NO: 54042 - DNA, 1046 bp, Homo sapiens
agcatactgccctatggggacagcatggatagaatagaaaaggaccgcctccaggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttaccg

SEQ ID NO: 54043 - DNA, 330 bp, Homo sapiens
gattgctgttaccaccctttacagtgcagtgatcacacccttgagaagccaggcagaaccaactgaaaggcatcgtggggcgtgcacatagcagctgcttgcaaagatggaagctgcctcacactcccccacaaccagcaagggcagtggctgccaggtatgacctcaggtgaccatcctgtgcattctgaaaactgggaagtcaaactctccaggctcctgactggccagtaggcttcaccagagctggatcaaccagaagaagctgaaacatccaacctaagaatttcgaacttcaaatggaaaatctgggcactctaaaccaaaatt

SEQ ID NO: 54044 - DNA, 204 bp, Homo sapiens
agggaggccgtgtccctagtgattagttgctgcacacacttgttggagtgagtgtctttaagtccaacggggagccctgtccccagccatttcccgcttcaccttgggctcctccattcctcagccagcctagtttggactcttggtctgaactgagcagaactttcctctatcatgacagagtctgtatgtgtggggaagaga

SEQ ID NO: 54045 - DNA, 270 bp, Homo sapiens
catccttcgcttaccctaagaaggaaaaatgacaatagttacagacacaagagaaatatcaattatattcactggtgctaaccatccaagcaataagttatactgtcttcatccctgtaatttagattttaacagtgatatcagtaaagacatgaatgtacaatgctgagagtaaatcaggctgtagatgacttcccttgaagatcacgatgctaataattttgctcatcttgtatcataactagaatgtcacgcacacattttaagatg

SEQ ID NO: 54046 - DNA, 374 bp, Homo sapiens
tggggtttcgagggccagacggggcagagtagtctggaaagttacacaagagtggacatattcagagagcttaagacttgggaggggccatagagctagatcttcccaccaaaggggcctttttgacagatgtgcaaactgaggcccagagagggaaaaggattattgtctggggcaaaatagtttatagcatcagagttcagtttggctctgctaccagatctcccaagcttgaatcctggcacctacaatcttgggcaagttcctgagcctctctgtgcctcagctttcttagctataaaacgggggaaataattgagcttgtctcagggcatggtggggatcaaatgagtcaatgtgaagcacgctcgagc

SEQ ID NO: 54047 - DNA, 468 bp, Homo sapiens
aggtctgagccttggtccattcccccagtaagaggtaagggatatggacaggaaccagagaaagaggctaagaagatatgaccagtgatggaggaagaaaaccaagagaagatgctatcttggtgaagaaagtactttgatgagggggagagcttcatggtgtcgaggtctgttgaaaggggctgggtgcagtggctcatgcctgtaattccagcaatttggaagaacaagataggagaatctcttgaggccagtagtttgtgaccagcctgggcaacatagtgagacccccatctctatttaaaaaatagccaggcatggtggcacattcctgtcatcccaattactcaggaggctgagataggaggattacgtgagcccagaagtttgaggttgccatgagctagggccactgcactccaggctacaaaataaggccctgtccaaaaacagaaaaaaaaaaataat

SEQ ID NO: 54048 - DNA, 3093 bp, Homo sapiens
agcaagagcagaggcttaaggagctacactgggggaaggacaggggcaagcaggccaaggcctggccggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgtccaccccacacagatttatggccatcacaaagaacaattctcagacagggagcaggacatagggatgcccaagaagacaggctccagttctaccgtggacagcaaggatgaggatcactattctaaatgtcaagattgtatccaccgcctgggacaggtggtgagaagaaaattaggggaagactggatctttctggtgcttctgggactgctgatggctctggtcagctggagcatggactacgtcagtgccaaaagccttcaggcctacaagtggtcctacgcgcagatgcagcccagccttcctctgcagttcctggtctgggtcaccttcccactagtcctcatcctcttcagcgccctcttctgccacctcatctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagggccccttcgtccacattgccagcatctgtgctgctgtcctcagcaaattcatgtctgtgttctgcggggtatatgagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgctgtcaccatcactgctctgttcagaaccaatttccgaatggatttcccctttgacctgaaggaactaccagcttttgctgccatcgggatttgctgtgggctcctgggagctgtatttgtgtatctgcatcgccaagtcatgctcggtgtccgaaagcacaaggccctcagccagtttcttgctaagcaccgcctgctgtatcctggaattgttacctttgtcattgcctcattcaccttcccaccaggaatgggtcaattcatggctggagagttgatgccccgcgaagccatcagtactttgtttgacaacaatacatgggtgaaacacgcgggtgatcctgagagcctgggccagtcagctgtgtggattcacccccgggtcaacgttgtcatcatcatctttctcttcttcgtcatgaagttctggatgtccatcgtggccaccactatgcccataccctgcggaggcttcatgcctgtgtttgtgctaggagctgcatttggaaggctggtaggagaaatcatggccatgctctttcctgatggtattttgtttgatgacatcatctacaagatcctacctgggggctatgcagtaattggagcagcagcgctgactggtgccgtttcccacacagtctccacagctgtgatttgcttcgaattaacgggtcagattgctcacatcctgcccatgatggtggctgttatcttggccaacatggtggcccagagcctgcagccctctctctatgacagcatcatccaggtcaagaagctaccctacttgcctgaccttggctggaaccagctcagcaaatataccatctttgttgaggacatcatggtacgtgatgtgaagtttgtttcagcttcttacacatatggggagttgcgaaccctgctccagaccaccacagtcaagactttaccactggttgactcaaaagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggccccccggcgcgcctccaggccggcccgagtccttcgcctttgtggatgaggatgaggacgaagatctctctggcaagagcgagcttcctccttcccttgctctccacccctctactactgcccctctgtccccagaagagcccaatgggcctctgcctggccacaaacagcagccggaagcaccagagcctgcaggtcaaagaccctccatcttccagtccctgcttcactgcttgctgggcagagctcgccccacaaagaagaaaacaacccaggattccacagatttagtggataacatgtcacctgaagagattgaggcctgggagcaggagcagctgagccagcctgtctgttttgattcctgctgtattgaccagtctcccttccagctggtggagcagacaaccctgcacaagactcataccctgttttcactccttggcctccacctcgcttacgtgaccagcatggggaagctcaggggcgtcctggccctggaggagctacagaaggccattgaggggcacaccaagtctggggtgcagctccgccctccccttgccagcttccggaacacgacttcaactcgaaagagtaccggggcacctccatcttctgcagagaactggaacctgcctgaggacaggcctggggccactggaacaggggatgtgattgctgcctccccagagacccctgtgccatctccttccccagagccccctctctccctggccccaggcaaggtagagggcgagttggaggagctggagctggtggagagtccagggctggaagaggagctggccgacatcttgcagggccccagcctgcgatccacagacgaggaggatgaggatgaactgatcctttgaccccctcccacgacctcctcataaagaccgtggagaggc

SEQ ID NO: 54049 - DNA, 332 bp, Homo sapiens
tatgcttttttctttagttgattagtgattgccctagagtttacaatatacatttataaatcattcaaactcacttccaaataacactataccatttactgcttcaagggtagtatgagtaccttaaaacaacaaaataatcctaacttctctttcttgcctcttgcataattgctaccattcattttacaaatatatataaacacatataaacatatgtattatatgtacatatgtagttaaatacattgctgctattattttgaataaactattatatgttagatctgttggctataagaataaaagtttctattttattgttacttatt

SEQ ID NO: 54050 - DNA, 349 bp, Homo sapiens
aaagaaaatgccttgggaagacagatgcattttttcccactggtgttgcaattgctcaaatattttgaggatgaatatcctcaccttggaggcaagtttttaagagtgaatttgaattactggagcagtgaacaattatttagagtctggtataagtgaagaaaagaatcatgaccagtaagctgtcttgcaggtaccagcaaactgactctaaaatttatatggaaaggcaaagggattagaatagccaacataatactgaagaagttggaagactcacactatccaatttcaagatttactgtaaagctacagtaaccaagacaatgtggcactggtgaaaaagtaa

SEQ ID NO: 54051 - DNA, 716 bp, Homo sapiens
ggttgaggctgcagtgagctgcatttgcaccactgtactacagcctgggggacagaatgagaccctgtctcaaaaaaaacacaaaacaacaacggcaaaaaactccagctaattattttgcacactctgatttaagcaatagcaaaatggtttcaaccttttgaatccagatgtaacttctacatacagctctgatccaatatgctgaaagtactgcacacaaatttaactttttcttaatgtgcaaagggcattttatgaatataattattttattattctaaatttttttttctcttagtttttggaacctgaaatggacaaatttgcccccctgctccctttttttttctgagatggagtcttgctctgttatcaggctggagtgcagtggcgtgatctcggctcactgcaatctctgcctcctgggttcaagcgactctcctgcctcagcctcccgagtagctgggagtacaggcgcgcaccaccacacctggctaattttgtatttttagtagagatggggttttgccatgttggccaggatggactccatctcctgaccttgtgatccgcctgtctcggtctcccaaagtgctgggattacaggcatgagccaccacgcccggcctagtggtcatttttaagtgaaatgtgttcctctttcctgaagtcactgaaggctgtggctgattcagagggactttctgtcagat

SEQ ID NO: 54052 - DNA, 396 bp, Homo sapiens
cctggaaacaatcggaaaccctgccccatcggcctcacatcagcttcctctttccccgtggccacttcctcttacggcgcagggaacctctcctcctgggtttgtgggcacaggtcacgtatcactcagggtggcgtcttatcacaggcactgggtgactagtgcttagatgtcacaacactgctgcacagatggagagactgacgcccagaggggatgaggtctcagctcaaggtcacaagggcgcttaaggcggagtctaattctttagactcttgctcaaaacaagtgcttcacttattttgaaatctgaggtcttagagaaaggaagtgactatcaaattagaggaagaaatttcgcttgaagatgtgcacggaggcggcaaatccgtgcct

SEQ ID NO: 54053 - DNA, 301 bp, Homo sapiens
gcaacatgtcactagccagcaggtaaggggtaaggctgttctgcctcatctcccataccagtagctcctagactgtgctatttgcctgttttgattccttcaccccaagtttgtaggacctgaagaaatcgcgttgagcagtactgctaacagagctcagataagaggctgttacctaacacctgggagccttgtggaggttggctgggggtcacgtgactgcacctggccattgtctccggcaaccggagaaggctgttagtagtctctcggccctggtctcctggtgacatcagcacct

SEQ ID NO: 54054 - DNA, 379 bp, Homo sapiens
ctttaaatagagatgaagcttcagtcgcttgcttgctgttcacctcctgctgtgtggctcagttcctaacaggccgtggagcagtactggggtcccaacccatgatttacatgttcaacagaaataagaaaaggtgcttagcatcattacctagttctccagaggacaaaactctcaaaataagaaatggcctaggggcaaaagtcaaatcccaggtactatcaggaaaacatagtcataagtaaagttcaagacaacaacaggtgcagcagctcacacctgcaatcccagtgctttgggaagccaaggtgggaggattacttgaggccaagagtttgggatcaacttgggcaacatagcaagactcctctgcaaaaaa

SEQ ID NO: 54055 - DNA, 1027 bp, Homo sapiens
gcaatatataactgaaacataattacatacctagaagcgggataatagaaatcaacagggtgattcctactgtaatagaaacctaaaacacatggcaggagctttgggatcaggtggaggatggaagctggaagaaccttgaggagtctgttattgacaaatactattaaagaacagtgagtggggctggccgtggtggctcacacctataatcccagcactttgggaggcagaggtgggccgatcacctgaggtcaggaattcgagaccagcctggtcaacacggtgaaaccctgtctctactaaaaataccaaaattagccaggcgtggtgacgcgtgcctgtaatcctagctactggggaggctgaggcaggagaattgcttgaacccaggaggcggaagttgcagtgagccaagatcgcaccactgccctccagcttgggtgacagagagagactcagtctcaaaataaaataaaataaagaacagtgaggatactgttattgctggctggagaaaagggggattgacttaggtattggaagaacaattagctaaactactctgcagttatgtgaaagctagagaaggtacctagtgaacatgtggatctggctatggagatttctggatagaatggtgaaagggtggaatggttccttttgcatgcctgtgatatagtaccagagaagtgcagtgagctaaaaaagaaactgttccatttttcatcagaatttagaagaagcaattaaagaagccaggacttgcaggatttgaaataaaactacttttcattcctagttctccagaggacaaaactctcaaaataagaaatggcctaggggcaaaagtcaaatcccaggtactatcaggaaaacatagtcataagtaaagttcaagacaacaacaggtgcagcagctcacacctgcaatcccagtgctttgggaagccaaggtgggaggattacttgaggccaagagtttgggatcaacttgggcaacatagcaagactcctctgcaaaaaa

SEQ ID NO: 54056 - DNA, 1027 bp, Homo sapiens
atgggctttgtacctatgttagctttgcagcagaaagctgcagtatctaccatgtgtgttgtgattgtctattaacccttcggctgagccaaagaagttattgaggccagaggggctgtattttattggtttttgtcatccttgacacctctctctcccttacctcgtgcctgctcacctccagctcctctccatcttcccctgatttttttattaatttatcattgtggcaaaagacacataacataaaatttaccttcttaaccactttggttttttggggttttttttgagatggagtgttgctctgttgcccaggctggagtgcaatggtgccatcttggctcaccacaacctccacctcccaggttcaggagaattgcttgaacccaggaggcggaagttgcagtgagccaagatcgcaccactgccctccagcttgggtgacagagagagactcagtctcaaaataaaataaaataaagaacagtgaggatactgttattgctggctggagaaaagggggattgacttaggtattggaagaacaattagctaaactactctgcagttatgtgaaagctagagaaggtacctagtgaacatgtggatctggctatggagatttctggatagaatggtgaaagggtggaatggttccttttgcatgcctgtgatatagtaccagagaagtgcagtgagctaaaaaagaaactgttccatttttcatcagaatttagaagaagcaattaaagaagccaggacttgcaggatttgaaataaaactacttttcattcctagttctccagaggacaaaactctcaaaataagaaatggcctaggggcaaaagtcaaatcccaggtactatcaggaaaacatagtcataagtaaagttcaagacaacaacaggtgcagcagctcacacctgcaatcccagtgctttgggaagccaaggtgggaggattacttgaggccaagagtttgggatcaacttgggcaacatagcaagactcctctgcaaaaaa

SEQ ID NO: 54057 - DNA, 701 bp, Homo sapiens
aaaattctgggattattataacatgagcccctgtgtctggctatatataaaggttcttaaaaataaggaaatctttatatccctttttttgttttctttttttgagaccagggtctgcctgtgtcacccaggctggagtgcagtggcgtgatctcggcccactgtaacctctgcctactgggtccaagagattctccctcctcagcatatttattattttctgttctctggaagactttaataagcttggtgtggtttctcccgtaattgaaagaattcactagtgaaaccatctttacttgagattttctttaaggaaagatttttaataatacattccatttctttatttgactttggggctatttggatattctgtttctttcagcattagtaatttaatttatattttttaagaaatgtgtccgttttatactgacatggttttttttgtttgttttggggggaattttttttttttttgagacagggtgtcactctgttgcccaggctagagtgttgtggcacagttatggctcactacagccttaaactcgtgggctcaagcaatcctcccacctcacaggctcttgagtagctgggaccacaggtgtgtgtcaccacacccagcttattttttttattttttgtagagatttcttctttgacctatagataatttaggaatgtagttttaggcc

SEQ ID NO: 54058 - DNA, 360 bp, Homo sapiens
gggactcctgtgttttagctggattctaggaaattcctctttgtcctccatatgcttcagtccttttatgtggctcctttgaactaggtccagtctccaggaaactggagatgcccctccacaactgttttccaccctgatttgaatccccagtgtcctaggaatcaatatgcggtgagtggttacagtggaggaacgtttataccacaacagcaataaattctctgagggttagtataatataaacaattgacagtgaaacatctgtgcaatactggagtacagcagagctttagcacatgctttagcactacagaactgggattttatgcacgtcaaatcatgtttgacacaccccca

SEQ ID NO: 54059 - DNA, 692 bp, Homo sapiens
agaaatagcatttataaatgctaaataaatacttgctaagtattacagtgcttagaagctgtaagtgatgtgttatgaaacaaacctattgcttcaaattattggaaacttgtactatacatggaatatactcagcttactcatgcctggtgggcctagcatttagctgctagtcttggcttatttaccattagaaattccattgattgttttctcatgtctgtgcctcaatataataaatatttccttgttgtatggatacatgcactaataccttttgattaactacatgataaacacagtctagatcgtttgggtgggtagttctctagaatggagtatttaaaaaatggagactataataaaaatctaaattttaggagtattacaaaataatgcttaacagtttgggaggctgaggcaggaggataatttgaggccaggagtttaagactggcctgggcaacatagcaagacactgtctctacaaaatagcaacaacaaccaaaacaaaaattagctggctgtggtggtgcacacctgtagtcgtagctacttgggtggtgcacacctgtagtcgtagctacttgggaggctcatagggaggattgattgagcctaggagatagaggctttgtgaactctgatagtgccgttgcactccagtctggatgacagcgagactctctcaa

SEQ ID NO: 54060 - DNA, 281 bp, Homo sapiens
gtaagggtggagagagagactcctgcttctgggtgggaacagggtgccagcgtgaattggcactgtcctattgctatgatgatgactttttcctccctgcagctctggagcacttggaagcggttctgaagctcatttgcagctttgcatctgtttgcacgggcgtctcctgctgggagttgaggcttcctgccctcattggctgtctgaggctgcgctccctacctgcccgcagcgtccctgccccccacatccacccccagtagtgtaatgggacagct

SEQ ID NO: 54061 - DNA, 278 bp, Homo sapiens
ttggtcttgagctcctggcctaaactggttctccctcttggcttcctaaagtggtgggattatggtctgaatcatcatgcctggccctgaaaaattattttaatttacaacaccattttacatgttgtgaccctttttaccccttttagagtgtgtgtcttccttactcatttgttaaaacccatttaaaatgtaatcttgtagagcaacaaagattttattatctcagtgcttctgtgcgttggaaattcaggcatggcttagctaggaacctctgg

SEQ ID NO: 54062 - DNA, 4758 bp, Homo sapiens
cttggcagacactggatggttatgagcctgaacaagctgaaaaggggcaggaaaagaagtggaggcagcattcttcctatttaaagctgcatcgcttgaaaaaagttttcgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatgaaggatatggtgaagaaatagcctgcactcagaatggccagatgtacttaaacagggacatttggaaacctgccccttgtcagatctgtgtctgtgacaatggagccattctctgtgacaagatagaatgccaggatgtgctggactgtgccgaccctgtaacgccccctggggaatgctgtcctgtctgttcacaaacacctggaggtggcaatacaaattttggtagaggaagaaagggacaaaagggagaaccaggattagtgcctgttgtaacaggcatacgtggtcgtccaggaccggcaggacctccaggatcacagggaccaagaggagagcgagggccaaaaggaagacctggccctcgtggacctcagggaattgatggagaaccaggtgttcctggtcaacctggtgctccaggacctcctggacatccgtcccacccaggacccgatggcttgagcaggccgttttcagctcaaatggctgggttggatgaaaaatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagtccgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctgggtcgagctggaaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccattgggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgccatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaa
